US012553050B2

(12) United States Patent
Allan et al.

(10) Patent No.: US 12,553,050 B2
(45) Date of Patent: Feb. 17, 2026

(54) COMPOSITIONS AND METHODS FOR INHIBITING CYTOCHROME P450 FAMILY 7 SUBFAMILY A MEMBER 1 (CYP7A1) EXPRESSION

(71) Applicant: Takeda Pharmaceutical Company Limited, Osaka (JP)

(72) Inventors: Bernard Allan, Wellesley, MA (US); Brian Ko, San Diego, CA (US); Pawan Kumar, San Diego, CA (US); Naim Nazef, San Diego, CA (US); Jason Pickens, Chula Vista, CA (US)

(73) Assignee: Takeda Pharmaceutical Company Limited, Osaka (JP)

( * ) Notice: Subject to any disclaimer, the term of this patent is extended or adjusted under 35 U.S.C. 154(b) by 0 days.

(21) Appl. No.: 19/086,228

(22) Filed: Mar. 21, 2025

(65) Prior Publication Data

US 2025/0297260 A1 Sep. 25, 2025

Related U.S. Application Data

(60) Provisional application No. 63/568,617, filed on Mar. 22, 2024.

(51) Int. Cl.
*C12N 15/113* (2010.01)

(52) U.S. Cl.
CPC ........ *C12N 15/1137* (2013.01); *C12Y 114/14* (2013.01); *C12N 2310/14* (2013.01); *C12N 2310/321* (2013.01)

(58) Field of Classification Search
CPC ............ C12N 15/1137; C12N 2310/14; C12N 2310/321
USPC ..................... 435/6.1, 91.1, 91.31, 455, 458; 514/44 A; 536/23.1, 24.5
See application file for complete search history.

(56) References Cited

U.S. PATENT DOCUMENTS

| | | | | |
|---|---|---|---|---|
| 8,090,542 | B2 * | 1/2012 | Khvorova .......... | C12N 15/1135 435/6.1 |
| 8,101,348 | B2 | 1/2012 | Tuschl et al. | |
| 9,127,276 | B2 | 9/2015 | Prakash et al. | |
| 9,145,558 | B2 | 9/2015 | Prakash et al. | |
| 9,290,760 | B2 | 3/2016 | Rajeev et al. | |
| 9,399,775 | B2 | 7/2016 | Rajeev et al. | |
| 9,796,974 | B2 | 10/2017 | Rajeev et al. | |
| 10,676,742 | B2 | 6/2020 | Brown et al. | |
| 10,683,499 | B2 | 6/2020 | Prakash et al. | |
| 11,015,198 | B2 | 5/2021 | Hauptmann et al. | |
| 11,504,391 | B1 | 11/2022 | Schlegel et al. | |
| 11,655,473 | B2 | 5/2023 | Dudek et al. | |
| 11,661,604 | B2 | 5/2023 | Brown et al. | |
| 2005/0042664 | A1 | 2/2005 | Wu et al. | |

FOREIGN PATENT DOCUMENTS

WO WO 2022/204430 A1 9/2022

OTHER PUBLICATIONS

GenBank Gene ID 102132452; CYP7A1 cytochrome P450 family 7 subfamily A member 1 [*Macaca fascicularis* (crab-eating macaque). Last updated: May 19, 2025.
GenBank Gene ID 13122; Cyp7a1 cytochrome P450, family 7, subfamily a, polypeptide 1 [*Mus musculus* (house mouse)]. Last updated: May 3, 2025.
GenBank Gene ID 1581; CYP7A1 cytochrome P450 family 7 subfamily A member 1 [*Homo sapiens* (human)]. Last updated: May 3, 2025.
GenBank Gene ID 25428; Cyp7a1 cytochrome P450 family 7 subfamily A member 1 [*Rattus norvegicus* (Norway rat)]. Last updated: May 15, 2025.
GenBank Gene ID 464191; CYP7A1 cytochrome P450 family 7 subfamily A member 1 [*Pan troglodytes* (chimpanzee)]. Last updated: Aug. 17, 2024.
GenBank Submission; NCBI, Accession No. NM_000780.4; *Homo sapiens* cytochrome P450 family 7 subfamily A member 1 (CYP7A1), mRNA. Feb. 10, 2024.
GenBank Submission; NCBI, Accession No. NM_007824.3; Mus musculus cytochrome P450, family 7, subfamily a, polypeptide 1 (Cyp7a1), mRNA. Feb. 9, 2024.
GenBank Submission; NCBI, Accession No. NM_012942.2; Rattus norvegicus cytochrome P450 family 7 subfamily A member 1 (Cyp7a1), mRNA. Feb. 4, 2024.
GenBank Submission; NCBI, Accession No. NP_000771.2; cytochrome P450 7A1 [*Homo sapiens*]. Feb. 10, 2024.
GenBank Submission; NCBI, Accession No. NP_031850.2; cytochrome P450 7A1 [Mus musculus]. Feb. 9, 2024.
GenBank Submission; NCBI, Accession No. NP_037074.1; cytochrome P450 7A1 [Rattus norvegicus]. Feb. 4, 2024.
GenBank Submission; NCBI, Accession No. XM_005563370.2; Predicted: Macaca fascicularis cholesterol 7-alpha-monooxygenase (LOC102132452), transcript variant X1, mRNA. Jan. 25, 2016.
GenBank Submission; NCBI, Accession No. XM_519773.3; Predicted: Pan troglodytes cytochrome P450 family 7 subfamily A member 1 (CYP7A1), mRNA. Mar. 20, 2018.
GenBank Submission; NCBI, Accession No. XP_005563427.1; cytochrome P450 7A1 [Macaca fascicularis]. Dec. 8, 2021.
UniProt ID G7PBW5; *Macaca fascicularis* (Crab-eating macaque) (Cynomolgus monkey). Entry Version 74, Sequence Version 1. Jan. 25, 2012. Last updated: Apr. 23, 2025.

(Continued)

*Primary Examiner* — Jane J Zara
(74) *Attorney, Agent, or Firm* — Wolf, Greenfield & Sacks, P.C.

(57) ABSTRACT

RNAi agents (e.g., CYP7A1 RNAi agents) for inhibiting the expression of the CYP7A1 gene, compositions including the RNAi agents conjugated to a targeting moiety, and methods of use are described. Also disclosed are pharmaceutical compositions including one or more RNAi agents (e.g., CYP7A1 RNAi agents). Delivery of the RNAi agent(s) to liver cells in vivo inhibits CYP7A1 gene expression and treats a CYP7A1 disease or a CYP7A1-associated disease.

27 Claims, 1 Drawing Sheet

Specification includes a Sequence Listing.

(56) References Cited

OTHER PUBLICATIONS

UniProt ID P18125; *Rattus norvegicus* (Rat). Entry Version 182, Sequence Version 1. Nov. 1, 1990. Last updated: Apr. 23, 2025.
UniProt ID Q64505; *Mus musculus* (Mouse). Entry Version 171, Sequence Version 1. Nov. 1, 1996. Last updated: Apr. 23, 2025.
UniProt ID P22680; *Homo sapiens* (Human). Entry Version 213, Sequence Version 2. Aug. 1, 1991. Last updated: Apr. 23, 2025.
UniProt ID H2QW73; *Pan troglodytes* (Chimpanzee). Entry Version 80, Sequence Version 1. Mar. 21, 2012. Last updated: Apr. 23, 2025.
Goldspiel et al., Human gene therapy. Clin Pharm. Jul. 1993;12(7):488-505.
Hu et al., Therapeutic siRNA: State of the Art. Signal Transduct Target Ther. Jun. 19, 2020;5(1):101. doi: 10.1038/s41392-020-0207-x.
Lima et al., Single-stranded siRNAs activate RNAi in animals. Cell. Aug. 31, 2012;150(5):883- 94. doi: 10.1016/j.cell.2012.08.014.
Morgan et al., Human gene therapy. Annu Rev Biochem. 1993:62:191-217. doi: 10.1146/annurev.bi.62.070193.001203.
Mulligan, The basic science of gene therapy. Science. May 14, 1993;260(5110):926-32. doi:10.1126/science.8493530.
Robinson, Gene Therapy-proceeding from laboratory to clinic. TibTech Biotechnology. May 1993; 11(5):155-215.
Tolstoshev, Gene therapy, concepts, current trials and future directions. Annu Rev Pharmacol Toxicol. 1993:33:573-96. doi:10.1146/annurev.pa.33.040193.003041.
Wu et al., Delivery systems for gene therapy. Biotherapy. 1991;3(1):87-95. doi:10.1007/BF02175102.
Invitation to Pay Additional Fees for Application No. PCT/IB2025/000110, mailed Oct. 6, 2025.
Fuchs et al., GLP-2 Improves Hepatic Inflammation and Fibrosis in Mdr2-/- Mice Via Activation of NR4a1/Nur77 in Hepatic Stellate Cells and Intestinal FXR Signaling. Cell Mol Gastroenterol Hepatol. 2023;16(5):847-856. doi: 10.1016/j.jcmgh.2023.08.003. Epub Aug. 10, 2023.
Tan et al., Trimethylamine N-Oxide Aggravates Liver Steatosis through Modulation of Bile Acid Metabolism and Inhibition of Farnesoid X Receptor Signaling in Nonalcoholic Fatty Liver Disease. Mol Nutr Food Res. Sep. 2019;63(17):e1900257. doi: 10.1002/mnfr.201900257. Epub May 22, 2019.

* cited by examiner

| sense numbering | 5' | | | 1 | 2 | 3 | 4 | 5 | 6 | 7 | 8 | 9 | 10 | 11 | 12 | 13 | 14 | 15 | 16 | 17 | 18 | 19 | 20 | 21 | 3' |
|---|---|---|---|---|---|---|---|---|---|---|---|---|---|---|---|---|---|---|---|---|---|---|---|---|---|
| MOD1 | sense | | | mN | mN | mN | mN | mN | mN | mN | mN | fN | fN | fN | fN | mN | mN | mN | mN | mN | mN | mN | mN | mN | MOD1 |
| | antisense | mN | mN | mN | mN | mN | mN | mN | mN | mN | fN | mN | mN | mN | fN | mN | fN | fN | mN | fN | mN | fN | fN | mN | |
| MOD2 | sense | | | mN | mN | mN | mN | mN | mN | mN | mN | fN | fN | fN | fN | mN | mN | mN | mN | mN | mN | mN | mN | mN | MOD2 |
| | antisense | mN | mN | mN | mN | mN | mN | mN | mN | mN | fN | mN | mN | mN | fN | mN | mN | fN | fN | fN | mN | fN | fN | mN | |
| MOD3 | sense | | | mN | mN | mN | mN | mN | mN | mN | mN | fN | fN | fN | fN | mN | mN | mN | mN | mN | mN | mN | mN | mN | MOD3 |
| | antisense | mN | mN | mN | mN | mN | mN | mN | mN | mN | fN | mN | mN | mN | fN | mN | fN | fN | fN | fN | mN | fN | fN | mN | |
| MOD4 | sense | | | mN | mN | mN | mN | mN | mN | mN | mN | fN | fN | fN | fN | mN | mN | mN | mN | mN | mN | mN | mN | mN | MOD4 |
| | antisense | mN | mN | mN | mN | mN | mN | mN | mN | mN | fN | mN | mN | mN | fN | mN | mN | fN | mN | mN | mN | fN | fN | mN | |
| antisense numbering | 3' | 23 | 22 | 21 | 20 | 19 | 18 | 17 | 16 | 15 | 14 | 13 | 12 | 11 | 10 | 9 | 8 | 7 | 6 | 5 | 4 | 3 | 2 | 1 | 5' |

COMPOSITIONS AND METHODS FOR INHIBITING CYTOCHROME P450 FAMILY 7 SUBFAMILY A MEMBER 1 (CYP7A1) EXPRESSION

RELATED APPLICATIONS

This application claims the benefit under 35 U.S.C. § 119(e) of U.S. Provisional Application Ser. No. 63/568,617, filed Mar. 22, 2024, entitled "COMPOSITIONS AND METHODS FOR INHIBITING CYTOCHROME P450 FAMILY 7 SUBFAMILY A MEMBER 1 (CYP7A1) EXPRESSION", the entire contents of which are incorporated herein by reference.

REFERENCE TO AN ELECTRONIC SEQUENCE LISTING

The content of the electronic sequence listing (T083370043US03-SEQ-ZJG.xml; Size: 2,687,552 bytes; and Date of Creation: Mar. 16, 2025) is herein incorporated by reference in its entirety.

FIELD OF THE INVENTION

The invention relates to compositions (e.g., RNAi agent compositions) for inhibiting gene expression of Cytochrome P450 family 7 subfamily A member 1 (CYP7A1).

BACKGROUND OF INVENTION

Primary sclerosing cholangitis (PSC) is a rare progressive liver disease characterized by inflammation of the bile ducts, liver fibrosis, cirrhosis, and end-stage liver disease. Patients frequently present with concurrent inflammatory bowel disease (IBD). The risk factors and mechanisms driving pathogenesis are unknown, but include human leukocyte antigen (HLA) genetics, immune dysfunction, gut-to-liver lymphocyte homing, dysbiosis and intra-hepatic accumulation of toxic bile acids. Diagnosis is based on elevated alkaline phosphatase (ALP) and characteristic magnetic resonance cholangiography (MRC) findings (beading and stricturing of bile ducts). Fatigue and pruritus are the most common early symptoms, with jaundice, abdominal pain, fever, weight loss and signs of portal hypertension occurring in later stages. The median survival from diagnosis of PSC until liver transplantation or PSC-related death is estimated to be 13-21 years. Although it is a rare condition, with a prevalence of PSC about ~1-12 per 100,000 worldwide and approximately 80,000 patients in major markets, PSC is the fifth most common indication for liver transplantation in the US and a leading indication in other countries. Furthermore, PSC represents a very significant health burden due to increased risk of colorectal cancer in children and young adults, bacterial cholangitis and the risk of all-cause hepatopancreatobiliary malignancy, cholangiocarcinoma and premature mortality compared to patients with IBD and the general population.

There are no approved therapies for the treatment of PSC and, to date, no investigational drug that prevents progression of liver disease in PSC patients has progressed to pivotal clinical trials. Current clinical practice is limited to off-label use of ursodeoxycholic acid (UDCA), despite evidence of long-term negative outcomes of UDCA in PSC patients, and managing complications, such as dilatation of dominant strictures and early diagnosis of cholangiocarcinoma. Liver transplantation is currently the only life-extending therapy for PSC patients progressing to liver failure. However, liver transplantation does not preclude recurrence of the disease.

CYP7A1 is a member of the cytochrome P450 superfamily of enzymes. The cytochrome P450 proteins are monooxygenases which catalyze many reactions involved in drug metabolism and synthesis of cholesterol, steroids and other lipids. This endoplasmic reticulum membrane protein catalyzes the first reaction in the cholesterol catabolic pathway in the liver, which converts cholesterol to bile acids. This reaction is the rate limiting step and the major site of regulation of bile acid synthesis, which is the primary mechanism for the removal of cholesterol from the body.

Certain liver disorders are characterized by perturbed bile acid homeostasis. These disorders include PSC, and additional cholestatic diseases such as progressive familial intrahepatic cholestasis (PFIC) and primary biliary cholangitis (PBC), and other liver diseases such as nonalcoholic steatohepatitis (NASH), nonalcoholic fatty liver disease (NAFLD), and alcoholic liver disease (ALD). Liver disorders with perturbed bile acid homeostasis may benefit from the inhibition of CYP7A1 activities.

Accordingly, there is a need in the art for compositions and methods for treating PSC and other disorders by inhibiting CYP7A1 activities.

SUMMARY OF INVENTION

The present disclosure, in some aspects, provides RNAi agents which effect the RNA-induced silencing complex (RISC)-mediated cleavage of RNA transcripts of a gene encoding Cytochrome P450 family 7 subfamily A member 1 (CYP7A1). The CYP7A1 RNA transcript may be within a cell, e.g., a cell within a subject, such as a human subject. Compositions comprising such RNAi agents and methods of using such (e.g., for treating a CYP7A1-associated disease) are also provided.

Some aspects of the present disclosure provide RNAi agents for inhibiting expression of Cytochrome P450 family 7 subfamily A member 1 (CYP7A1) in a cell, wherein the RNAi agent comprises a sense strand and an antisense strand forming a duplex region, wherein the antisense strand comprises a region of complementarity of at least 15 nucleosides (e.g., at least 15, 16, 17, 18, 19, 20, 21, 22, or 23 nucleosides) to a CYP7A1 target sequence in Table 2, wherein the region of complementarity comprises a nucleobase sequence that contains no more than 3 (e.g., 0, 1, 2, or 3) mismatches to the CYP7A1 target sequence, and wherein the sense strand is at least substantially complementary to the antisense strand.

Some aspects of the present disclosure provide RNAi agents for inhibiting expression of Cytochrome P450 family 7 subfamily A member 1 (CYP7A1) in a cell, wherein the RNAi agent comprises a sense strand and an antisense strand forming a duplex region, wherein the antisense strand comprises a region of complementarity of at least 15 nucleosides (e.g., at least 15, 16, 17, 18, 19, 20, 21, 22, or 23 nucleosides) to a CYP7A1 target sequence of nucleotides 113-133, 221-241, 249-269, 290-310, 301-321, 475-495, 476-496, 504-524, 593-613, 600-620, 671-691, 779-799, 839-859, 842-862, 1003-1023, 1009-1029, 1037-1057, 1082-1102, 1189-1209, 1207-1227, 1215-1235, 1225-1245, 1226-1246, 1235-1255, 1289-1309, 1296-1316, 1384-1404, 1415-1435, 1431-1451, or 1559-1579 of SEQ ID NO: 1, wherein the region of complementarity comprises a nucleobase sequence that contains no more than 3 (e.g., 0, 1, 2, or 3) mismatches to the CYP7A1 target sequence, and wherein the sense strand is at least substantially complementary to the antisense strand.

In some embodiments, the region of complementarity is at least 17 nucleosides (e.g., at least 17, 18, or 19 nucleosides) in length. In some embodiments, the region of complementarity is 19-21 (e.g., 19, 20, or 21) nucleosides in length.

In some embodiments, the antisense strand comprises at least 15 consecutive nucleobases (e.g., at least 15, 16, 17, 18, 19 nucleobases) of any one of SEQ ID NOs: 777-1190. In some embodiments, the sense strand comprises at least 15 consecutive nucleobases (e.g., at least 15, 16, 17, 18, 19 nucleobases) of any one of SEQ ID NOs: 393-776.

In some embodiments, the sense strand is 21 nucleosides in length and the antisense strand is 23 nucleosides in length, optionally wherein the RNAi agent comprises a 3' overhang of at least 1 nucleoside (e.g., 1, 2, or 3) on a least one strand (e.g., on the sense and/or antisense strand).

In some embodiments, the antisense strand comprises nucleobases 2-21 (counting 5'→3') of any one of SEQ ID NOs: 777-1190 and the sense strand comprises the nucleobase sequence of any one of SEQ ID NOs: 393-776. In some embodiments, the antisense strand comprises the nucleobase sequence of any one of SEQ ID NOs: 777-1190 and the sense strand comprises the nucleobase sequence of any one of SEQ ID NOs: 393-776.

In some embodiments, the RNAi agent comprises the nucleobases sequences of an siRNA selected from siRNA1-siRNA384, siRNA12', siRNA27', siRNA38', siRNA47', siRNA51', siRNA72', siRNA73', siRNA81', siRNA100', siRNA101', siRNA118', siRNA122', siRNA124', siRNA125', siRNA158', siRNA161', siRNA172', siRNA174', siRNA190', siRNA199', siRNA203', siRNA205', siRNA206', siRNA212', siRNA226', siRNA231', siRNA250', siRNA256', siRNA260', and siRNA272'.

In some embodiments, the antisense strand comprises nucleobases 2-21 (counting 5'→3') of a nucleobase sequence selected from (5'→3'):

(i) (SEQ ID NO: 1161)
UUUGCUCUGAGGAACUCAAGAAG (ii) (SEQ ID NO: 1162)
UUGUCAUUGAGAAACAUGCGCAG (iii) (SEQ ID NO: 1165)
UUAACUGUGGGUAAAGAGCUAAG (iv) (SEQ ID NO: 1166)
UAUACUGGCAGGUCAUUCAGUAG (v) (SEQ ID NO: 1169)
UGAUUUGUGAUGAAAUGGACAAG (vi) (SEQ ID NO: 1173)
UCUAAGUGCAUUAACUGUGGGAG (vii) (SEQ ID NO: 1174)
UUUAACUGUGGGUAAAGAGCUAG (viii) (SEQ ID NO: 1180)
UCAAGAAUAAGCCAUAGACAAAG -continued (ix) (SEQ ID NO: 1181)
UUUCCGUGAGGGAAUUCAAGGAG (x) (SEQ ID NO: 1184)
UGUAUGACAAGGGAUUUGUGAAG (xi) (SEQ ID NO: 1188)
UAAAUACCCAGCUUCAAACAUAG;
and (xii) (SEQ ID NO: 1190)
UAUGAUACGUUGGAGGUUUUCAG.

In some embodiments, the antisense strand comprises a nucleobase sequence selected from (5'→3'):

(i) (SEQ ID NO: 1161)
UUUGCUCUGAGGAACUCAAGAAG (ii) (SEQ ID NO: 1162)
UUGUCAUUGAGAAACAUGCGCAG (iii) (SEQ ID NO: 1165)
UUAACUGUGGGUAAAGAGCUAAG (iv) (SEQ ID NO: 1166)
UAUACUGGCAGGUCAUUCAGUAG (v) (SEQ ID NO: 1169)
UGAUUUGUGAUGAAAUGGACAAG (vi) (SEQ ID NO: 1173)
UCUAAGUGCAUUAACUGUGGGAG (vii) (SEQ ID NO: 1174)
UUUAACUGUGGGUAAAGAGCUAG (viii) (SEQ ID NO: 1180)
UCAAGAAUAAGCCAUAGACAAAG (ix) (SEQ ID NO: 1181)
UUUCCGUGAGGGAAUUCAAGGAG (x) (SEQ ID NO: 1184)
UGUAUGACAAGGGAUUUGUGAAG (xi) (SEQ ID NO: 1188)
UAAAUACCCAGCUUCAAACAUAG;
and (xii) (SEQ ID NO: 1190)
UAUGAUACGUUGGAGGUUUUCAG.

In some embodiments, the sense strand comprises a nucleobase sequence selected from (5'→3'):

(i) (SEQ ID NO: 419)
UCUUGAGUUCCUCAGAGCAAA;

(ii) (SEQ ID NO: 517)
GCGCAUGUUUCUCAAUGACAA;

(iii) (SEQ ID NO: 597)
UAGCUCUUUACCCACAGUUAA;

(iv) (SEQ ID NO: 566)
ACUGAAUGACCUGCCAGUAUA;

(v) (SEQ ID NO: 439)
UGUCCAUUUCAUCACAAAUCA;

(vi) (SEQ ID NO: 604)
CCCACAGUUAAUGCACUUAGA;

(vii) (SEQ ID NO: 598)
AGCUCUUUACCCACAGUUAAA;

(viii) (SEQ ID NO: 404)
UUGUCUAUGGCUUAUUCUUGA;

(ix) (SEQ ID NO: 464)
CCUUGAAUUCCCUCACGGAAA;

(x) (SEQ ID NO: 443)
UCACAAAUCCCUUGUCAUACA;

(xi) (SEQ ID NO: 493)
AUGUUUGAAGCUGGGUAUUUA;
and (xii) (SEQ ID NO: 473)
GAAAACCUCCAACGUAUCAUA.

In some embodiments, the RNAi agent comprises one or more (e.g., any integers between 1-45) modified nucleosides. In some embodiments, each nucleoside of the antisense strand is a modified nucleoside and each nucleoside of the sense strand is a modified nucleoside. In some embodiments, the one or more modified nucleosides are 2' modified nucleosides. In some embodiments, the 2'-modified nucleoside is selected from 2'-fluoro (2'-F), 2'-O-methyl (2'-O-Me), 2'-O-methoxyethyl (2'-MOE), 2'-O-aminopropyl (2'-O-AP), 2'-0-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O-NMA) modified nucleoside and combinations thereof. In some embodiments, the 2'-modified nucleoside is selected from a 2'-O-methyl (2'-O-Me) modified nucleoside, a 2'-fluoro (2'-F) modified nucleoside, 2'-MOE modified nucleoside, and any combinations thereof. In some embodiments, each nucleoside of the antisense strand is selected from a 2'-F modified nucleoside and a 2'-O-Me modified nucleoside, and each nucleoside of the sense strand is a 2'-modified nucleoside selected from a 2'-F modified nucleoside and a 2'-O-Me modified nucleoside.

In some embodiments, the RNAi agent comprises a sense strand and an antisense strand, wherein the nucleosides at positions 9, 10, 11, and 12 (counting 5'→3') of the sense strand are nucleosides with the same 2' chemistry in the sugar moiety, e.g., 2'-F modified nucleoside, 2'-O-Me modified nucleoside, 2'-MOE modified nucleoside, or 2'-deoxy nucleoside and the nucleosides at positions 8 or 13 (counting 5'→3') are nucleosides with different 2' chemistry in the sugar moiety including, e.g., unmodified nucleosides, i.e., 2'-hydroxy nucleosides. In some embodiments, the RNAi agent comprises a sense strand and an antisense strand, wherein the nucleosides at positions 9, 10, 11, and 12 (counting 5'→3') of the sense strand are unmodified nucleosides, i.e., 2'-hydroxy nucleosides, and the nucleosides at positions 8 and 13 (counting 5'→3') have a different 2' chemistry in the sugar moiety, e.g., 2'-F modified nucleoside, 2'-O-Me modified nucleoside, 2'-MOE modified nucleoside or 2'-deoxy nucleoside.

In some embodiments, the RNAi agent comprises a sense strand and an antisense strand, wherein the nucleosides at positions 9, 10, 11, 12 (counting 5'→3') of the sense strand are 2'-F modified nucleosides and the nucleosides at positions 8 and 13 (counting 5'→3') are not 2'-F modified nucleosides, e.g., are 2'-O-Me modified nucleosides, 2'-MOE modified nucleosides, 2'-deoxy nucleosides, or 2'-hydroxy nucleosides. In some embodiments, one or more nucleosides of the sense strand that are not 2'-F modified nucleosides (e.g., nucleosides at positions 1, 2, 3, 4, 5, 6, 7, 8 and 13, 14, 15, 16, 17, 18, 19, 20, 21 (counting 5'→3') of the sense strand) are 2'-O-Me modified nucleosides. In some embodiments, all nucleosides of the sense strand that are not 2'-F modified nucleosides (e.g., nucleosides at positions 1, 2, 3, 4, 5, 6, 7, 8 and 13, 14, 15, 16, 17, 18, 19, 20, 21 (counting 5'→3') of the sense strand) are 2'-O-Me modified nucleosides.

In some embodiments, the RNAi agent comprises a sense strand and an antisense strand, wherein the nucleosides at one or more of positions 2, 3, 5, 6, 7, 8, 10, and 14 (counting 5'→3') of the antisense strand are 2'-F modified nucleosides. In some embodiments, the RNAi agent comprises a sense strand and an antisense strand, wherein the nucleosides positions 2 and 14 (counting 5'→3') of the antisense strand are 2'-F modified nucleosides. In some embodiments, the RNAi agent comprises a sense strand and an antisense strand, wherein the nucleosides at positions 2, 3, 7, 10, and 14 (counting 5'→3') of the antisense strand are 2'-F modified nucleosides. In some embodiments, the RNAi agent comprises a sense strand and an antisense strand, wherein the nucleosides at positions 2, 3, 7, 10, and 14 (counting 5'→3') of the antisense strand are 2'-F modified nucleosides, and one or more of positions 5, 6, and 8 (counting 5'→3') of the antisense strand are 2'-F modified nucleosides. In some embodiments, the RNAi agent comprises a sense strand and an antisense strand, wherein the nucleosides at one or more of positions 2, 3, 5, 6, 7, 8, 10, and 14 (counting 5'→3') of the antisense strand are 2'-F modified nucleosides and the nucleosides at other positions are not 2'-F modified nucleoside, e.g., are 2'-O-Me modified nucleosides, 2'-MOE modified nucleosides, 2'-deoxy nucleosides, or 2'-hydroxy nucleosides. In some embodiments, the RNAi agent comprises a sense strand and an antisense strand, wherein the nucleosides at one or more of positions 2, 3, 5, 6, 7, 8, 10, and 14 (counting 5'→3') of the antisense strand are 2'-F modified nucleosides and all that are not 2'-F modified are 2'-O-Me modified nucleoside.

In some embodiments, the RNAi agent comprises a sense strand and an antisense strand, wherein the nucleosides at one or more positions at 1, 4, 5, 6, 8, 9, 11, 12, 13, 15, 16, 17, 18, 19, 20, 21, 22, and 23 of the antisense strand are not 2'-F modified nucleosides, e.g., are 2'-O-Me modified nucleosides, 2'-MOE modified nucleosides, 2'-deoxy nucleosides, or 2'-hydroxy nucleosides. In some embodiments, the RNAi agent comprises a sense strand and an antisense strand, wherein the nucleosides positions at one or more positions 1, 4, 5, 6, 8, 9, 11, 12, 13, 15, 16, 17, 18, 19, 20, 21, 22, and 23 of the antisense strand are 2'-O-Me modified nucleosides.

In some embodiments, the RNAi agent comprises a sense strand and an antisense strand, wherein the nucleosides positions at 1, 4, 9, 11, 12, 13, 15, 16, 17, 18, 19, 20, 21, 22, and 23 of the antisense strand are not 2'-F modified nucleosides, e.g., are 2'-O-Me modified nucleosides, 2'-MOE modified nucleosides, 2'-deoxy nucleosides, or 2'-hydroxy nucleosides. In some embodiments, the RNAi agent comprises a sense strand and an antisense strand, wherein the nucleosides positions at 1, 4, 9, 11, 12, 13, 15, 16, 17, 18, 19, 20, 21, 22, and 23 of the antisense strand are 2'-O-Me modified nucleosides.

In some embodiments, the RNAi agent comprises one or more (e.g., 1, 2, 3, 4, 5, 6, 7, 8, 9, 10 or more) modified internucleoside linkages. In some embodiments, the RNAi agent comprises one or more (e.g., 1, 2, 3, 4, 5, 6, 7, 8, 9, 10 or more), phosphorothioate internucleoside linkages in at least one strand (e.g., sense strand and/or antisense strand).

In some embodiments, the RNAi agent comprises two phosphorothioate internucleoside linkages in the sense strand, optionally wherein the two phosphorothioate internucleoside linkages are the first two internucleoside linkages in the sense strand from 5'→3'. In some embodiments, the RNAi agent comprises four phosphorothioate internucleoside linkages in the antisense strand, wherein the four phosphorothioate internucleoside linkages are the first two internucleoside linkages and the last two internucleoside linkages in the antisense strand from 5'→3'.

In some embodiments, the RNAi agent comprises a sense strand and an antisense strand, wherein the nucleosides at positions 9, 10, 11, 12 (counting 5'→3') of the sense strand are 2'-F modified nucleosides, wherein the nucleosides at positions 2, 3, 5, 7, 8, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages.

In some embodiments, the RNAi agent comprises a sense strand and an antisense strand, wherein the nucleosides at positions 9, 10, 11, 12 (counting 5'→3') of the sense strand are 2'-F modified nucleosides, wherein the nucleosides at positions 2, 3, 5, 6, 7, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages.

In some embodiments, the RNAi agent comprises a sense strand and an antisense strand, wherein the nucleosides at positions 9, 10, 11, 12 (counting 5'→3') of the sense strand are 2'-F modified nucleosides, wherein the nucleosides at positions 2, 3, 5, 6, 7, 8, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages.

In some embodiments, the RNAi agent comprises a sense strand and an antisense strand, wherein the nucleosides at positions 9, 10, 11, 12 (counting 5'→3') of the sense strand are 2'-F modified nucleosides, wherein the nucleosides at positions 2, 3, 7, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages.

In some embodiments, the RNAi agent comprises an antisense strand and a sense strand, each comprising a structure as provided in Table 5B, Table 7B, or Table 9. In some embodiments, the RNAi agent comprises an antisense strand comprising a structure as set forth in any one of SEQ ID NOs: 1605-2054. In some embodiments, the RNAi agent comprises a sense strand comprising a structure as set forth in any one of SEQ ID NOs: 1191-1604. In some embodiments, the RNAi agent comprises an antisense strand comprising a structure as set forth in any one of SEQ ID NOs: 1605-2054 and a sense strand comprising a structure as set forth in any one of SEQ ID NOs: 1191-1604. In some embodiments, the CYP7A1 RNAi agent is selected from any one of the siRNAs listed in Tables 5B, 7B, and 9.

In some embodiments, the RNAi agent comprises:

an antisense strand comprising the nucleobase sequence of SEQ ID NO: 1173 and a structure (5'→3') of

[mUs][fCs][fU][mA][fA][mG][fU][fG][mC][fA][mU][mU][mA][fA][mC][mU][mG][mU][mG][mG][mGs][mAs][mG] (SEQ ID NO: 2016), wherein:

mA, mC, mG, and mU are 2'-O-methyl adenosine, 2'-O-methyl cytidine, 2'-O-methyl guanosine, and 2'-O-methyl uridine, respectively;

fA, fC, fG, and fU are 2'-fluoro adenosine, 2'-fluoro cytidine, 2'-fluoro guanosine, and 2'-fluoro uridine, respectively; and s is a phosphorothioate linkage; and/or a sense strand comprising the nucleobase sequence of SEQ ID NO: 604 and a structure (5'→3') of

[mCs][mCs][mC][mA][mC][mA][mG][mU][fU][fA][fA][fU][mG][mC][mA][mC][mU][mU][mA][mG][mAs] (SEQ ID NO: 1425), wherein:

mA, mC, mG, and mU are 2'-O-methyl adenosine, 2'-O-methyl cytidine, 2'-O-methyl guanosine, and 2'-O-methyl uridine, respectively;

fA, fC, fG, and fU are 2'-fluoro adenosine, 2'-fluoro cytidine, 2'-fluoro guanosine, and 2'-fluoro uridine, respectively; and s is a phosphorothioate linkage.

In some embodiments, the RNAi agent comprises:

an antisense strand comprising the nucleobase sequence of SEQ ID NO: 1174 and a structure (5'→3') of

[mUs][fUs][fU][mA][fA][mC][fU][fG][mU][fG][mG][mG][mU][fA][mA][mA][mG][mA][mG][mC][mUs][mAs][mG] (SEQ ID NO: 2020), wherein:

mA, mC, mG, and mU are 2'-O-methyl adenosine, 2'-O-methyl cytidine, 2'-O-methyl guanosine, and 2'-O-methyl uridine, respectively;

fA, fC, fG, and fU are 2'-fluoro adenosine, 2'-fluoro cytidine, 2'-fluoro guanosine, and 2'-fluoro uridine, respectively; and s is a phosphorothioate linkage; and/or a sense strand comprising the nucleobase sequence of SEQ ID NO: 598 and a structure (5'→3') of

[mAs][mGs][mC][mU][mC][mU][mU][mU][fA][fC][fC][fC][mA][mC][mA][mG][mU][mU][mA][mA][mAs] (SEQ ID NO: 1418), wherein:

mA, mC, mG, and mU are 2'-O-methyl adenosine, 2'-O-methyl cytidine, 2'-O-methyl guanosine, and 2'-O-methyl uridine, respectively;

fA, fC, fG, and fU are 2'-fluoro adenosine, 2'-fluoro cytidine, 2'-fluoro guanosine, and 2'-fluoro uridine, respectively; and s is a phosphorothioate linkage.

In some embodiments, the RNAi agent comprises:

an antisense strand comprising the nucleobase sequence of SEQ ID NO: 1180 and a structure (5'→3') of

[mUs][fCs][fA][mA][fG][fA][fA][fU][mA][fA][mG][mC][mC][fA][mU][mA][mG][mA][mC][mA][mAs][mAs][mG] (SEQ ID NO: 2029), wherein:

mA, mC, mG, and mU are 2'-O-methyl adenosine, 2'-O-methyl cytidine, 2'-O-methyl guanosine, and 2'-O-methyl uridine, respectively;

fA, fC, fG, and fU are 2'-fluoro adenosine, 2'-fluoro cytidine, 2'-fluoro guanosine, and 2'-fluoro uridine, respectively; and s is a phosphorothioate linkage; and/or a sense strand comprising the nucleobase sequence of SEQ ID NO: 404 and a structure (5'→3') of mA, mC, mG, and mU are 2'-O-methyl adenosine, 2'-O-methyl cytidine, 2'-O-methyl guanosine, and 2'-O-methyl uridine, respectively;

fA, fC, fG, and fU are 2'-fluoro adenosine, 2'-fluoro cytidine, 2'-fluoro guanosine, and 2'-fluoro uridine, respectively; and s is a phosphorothioate linkage; and/or a sense strand comprising the nucleobase sequence of SEQ ID NO: 464 and a structure (5'→3') of

[mCs][mCs][mU][mU][mG][mA][mA][mU][fU][fC][fC][fC][mU][mC][mA][mC][mG][mG][mA][mA][mAs] (SEQ ID NO: 1267), wherein:

mA, mC, mG, and mU are 2'-O-methyl adenosine, 2'-O-methyl cytidine, 2'-O-methyl guanosine, and 2'-O-methyl uridine, respectively;

fA, fC, fG, and fU are 2'-fluoro adenosine, 2'-fluoro cytidine, 2'-fluoro guanosine, and 2'-fluoro uridine, respectively; and s is a phosphorothioate linkage.

In some embodiments, the RNAi agent further comprises a targeting moiety. In some embodiments, the targeting moiety is conjugated to the 3' end of the sense strand of the RNAi agent. In some embodiments, the targeting moiety comprises N-acetyl-galactosamine (GalNAc). In some embodiments, the targeting moiety comprises a GalNAc trimer. In some embodiments, the targeting moiety comprises one or more instances of GalNAc attached through a monovalent, bivalent, trivalent, or tetravalent branched linker. In some embodiments, the targeting moiety comprises a structure of Formula ($Z^6$):

($Z^6$)

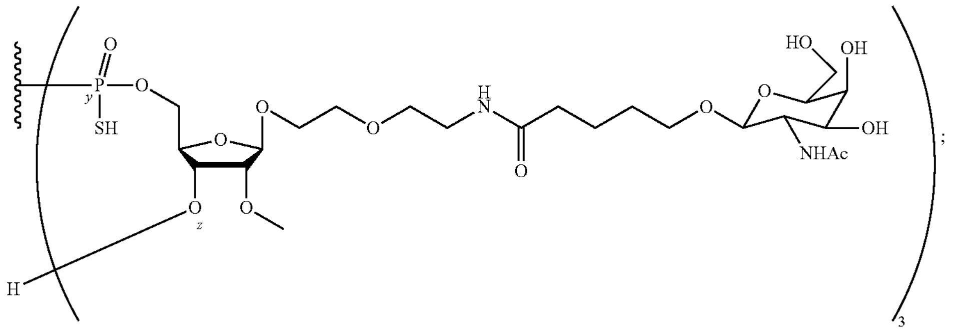

;

[mUs][mUs][mG][mU][mC][mU][mA][mU][fG][fG][fC][fU][mU][mA][mU][mU][mC][mU][mU][mG][mAs] (SEQ ID NO: 1202), wherein:

mA, mC, mG, and mU are 2'-O-methyl adenosine, 2'-O-methyl cytidine, 2'-O-methyl guanosine, and 2'-O-methyl uridine, respectively;

fA, fC, fG, and fU are 2'-fluoro adenosine, 2'-fluoro cytidine, 2'-fluoro guanosine, and 2'-fluoro uridine, respectively; and s is a phosphorothioate linkage.

In some embodiments, the RNAi agent comprises:

an antisense strand comprising the nucleobase sequence of SEQ ID NO: 1181 and a structure (5'→3') of

[mUs][fUs][fU][mC][fC][fG][fU][mG][mA][fG][mG][mG][mA][fA][mU][mU][mC][mA][mA][mG][mGs][mAs][mG] (SEQ ID NO: 2033), wherein:

or a pharmaceutically acceptable salt thereof, wherein the

indicates the attachment point that is covalently linked to the 3'-O of the sugar moiety of the 3' terminal nucleoside of the sense strand. For Formula ($Z^6$), with the exception of the phosphorous directly attached to the sense strand, each instance of phosphorous labeled y is bound to the oxygen labeled z of the adjacent unit, and with the exception of the oxygen directly attached to hydrogen, each instance of oxygen labeled z is bound to the phosphorous labeled y of the adjacent unit. In some embodiments, the targeting moiety comprises a structure of formula:

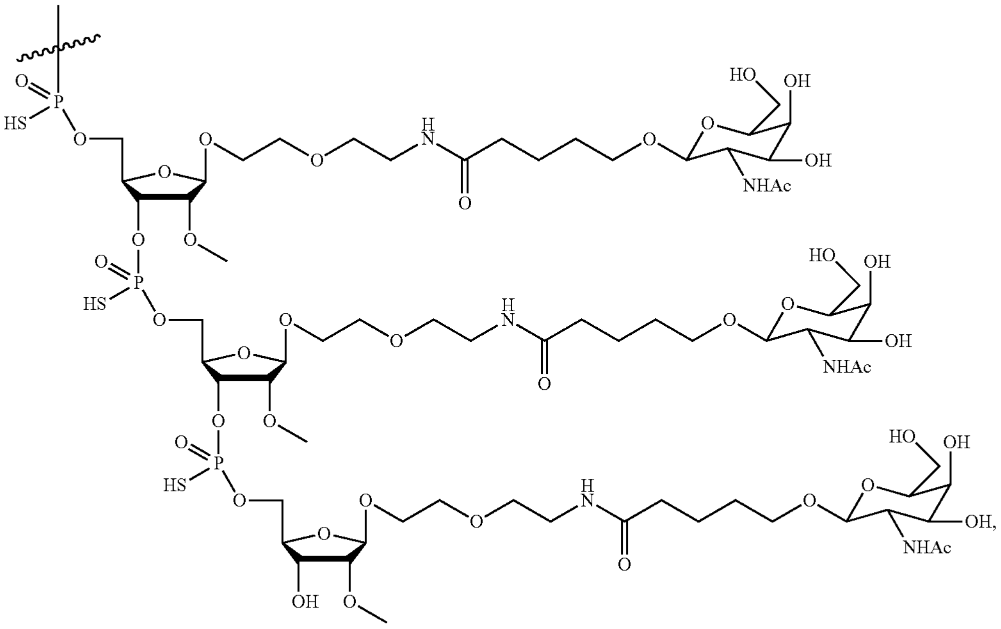

or a pharmaceutically acceptable salt thereof, wherein the

indicates the attachment point that is covalently linked to the 3'-O of the sugar moiety of the 3' terminal nucleoside of the sense strand.

It is to be understood that in an RNAi agent (e.g., CYP7A1 RNAi agent) that further comprises a targeting moiety conjugated to the 3' terminal nucleoside of the sense strand, the 3'-terminal nucleoside is linked to the targeting moiety via a phosphorothioate linkage. As such, when the 3'-terminal nucleoside of the sense strand is represented as [mAs](e.g., the sense strands of the siRNAs provided in Table 9 and elsewhere in the present disclosure), the "s" corresponds to the phosphorothioate linkage (e.g.,

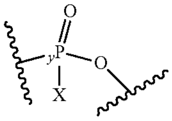

, wherein X is —SH, i.e.,

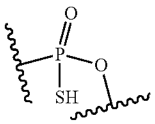

)

of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formulae: (I), (I-a), (I-a-1), (I-b), (I-b-1), (I-c), (I-c-1), (I-d), (I-d-1), (I-e), (I-e-1), (I-f), (I-f-1), (I-g), (I-h), (I-i), (I-j), (II), (II-a), (II-b), (II-c), (III), (III-a), (IV), (IV-a), (IV-b), (IV-c), (IV-d), (IV-e), (IV-f), or $(Z^1)$-$(Z^{16})$.

In some embodiments, the resulting conjugate comprises a structure of:

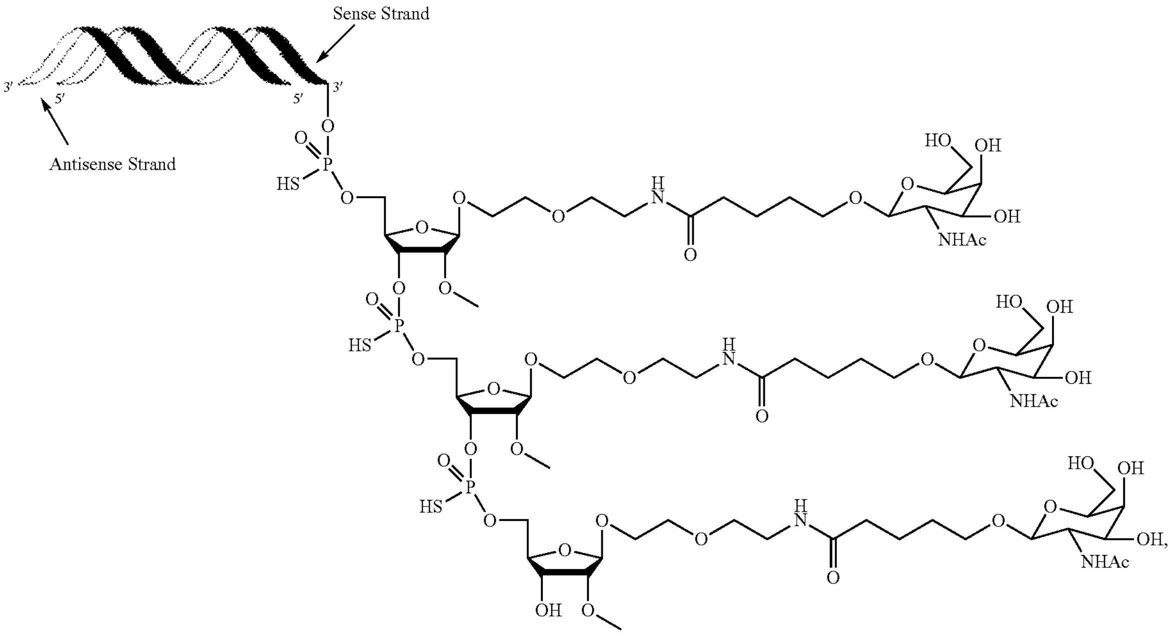

or a pharmaceutically acceptable salt thereof.

Further provided herein is an RNAi agent comprising:

an antisense strand comprising the nucleobase sequence of SEQ ID NO: 1173 and a structure (5'→3') of

[mUs][fCs][fU][mA][fA][mG][fU][fG][mC][fA][mU][mU][mA][fA][mC][mU][mG][mU][mG][mG][mGs][mAs][mG] (SEQ ID NO: 2016); and a sense strand comprising the nucleobase sequence of SEQ ID NO: 604 and a structure (5'→3') of

[mCs][mCs][mC][mA][mC][mA][mG][mU][fU][fA][fA][fU][mG][mC][mA][mC][mU][mU][mA][mG][mAs] (SEQ ID NO: 1425);

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage;

and wherein the 3' terminal nucleoside of the sense strand is covalently linked to a structure of Formula ($Z^6$)

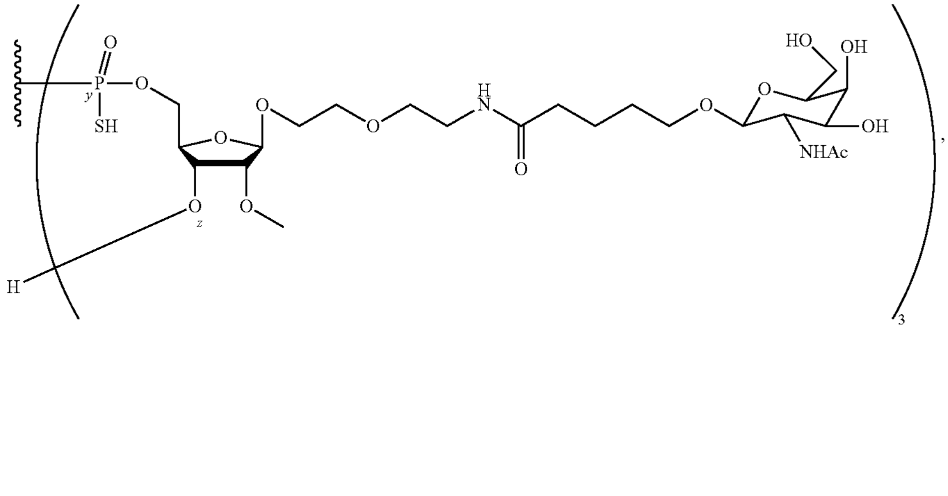

($Z^6$)

or a pharmaceutically acceptable salt thereof, wherein the

indicates the attachment point that is covalently linked to the 3'-O of the sugar moiety of the 3' terminal nucleoside of the sense strand. It is to be understood that the "s" of the 3'-terminal [mAs] of the sense strand corresponds to the phosphorothioate linkage (e.g.,

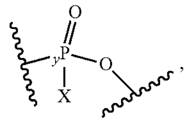

wherein X is —SH, i.e.,

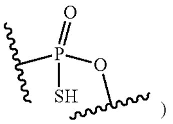

of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formula ($Z^6$).

Further provided herein is an RNAi agent comprising:

an antisense strand comprising the nucleobase sequence of SEQ ID NO: 1174 and a structure (5'→3') of

[mUs][fUs][fU][mA][fA][mC][fU][fG][mU][fG][mG][mG][mU][fA][mA][mA][mG][mA][mG][mC][mUs][mAs][mG] (SEQ ID NO: 2020); and a sense strand comprising the nucleobase sequence of SEQ ID NO: 598 and a structure (5'→3') of

[mAs][mGs][mC][mU][mC][mU][mU][mU][fA][fC][fC][fC][mA][mC][mA][mG][mU][mU][mA][mA][mAs] (SEQ ID NO: 1418);

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage;

and wherein the 3' terminal nucleoside of the sense strand is covalently linked to a structure of Formula ($Z^6$)

($Z^6$)

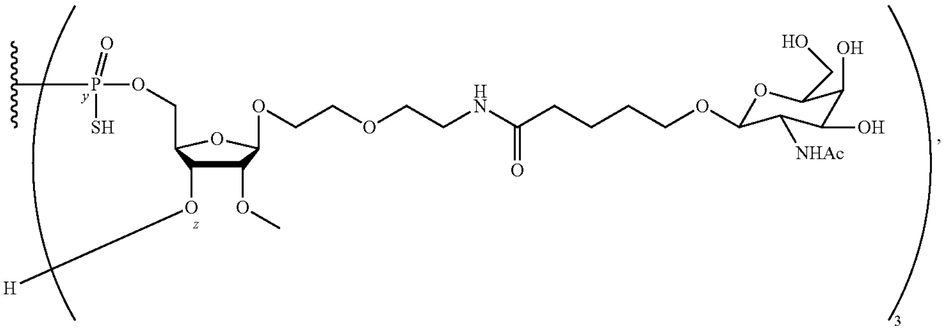

or a pharmaceutically acceptable salt thereof, wherein the

indicates the attachment point that is covalently linked to the 3'-O of the sugar moiety of the 3' terminal nucleoside of the sense strand. It is to be understood that the "s" of the 3'-terminal [mAs] of the sense strand corresponds to the phosphorothioate linkage (e.g.,

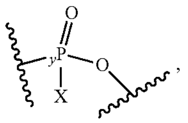

wherein X is —SH, i.e.,

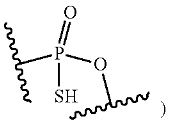

of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formula ($Z^6$).

Further provided herein is an RNAi agent comprising:

an antisense strand comprising the nucleobase sequence of SEQ ID NO: 1180 and a structure (5'→3') of [mUs][fCs][fA][mA][fG][fA][fA][fU][mA][fA][mG][mC][mC][fA][mU][mA][mG][mA][mC][mA][mAs][mAs][mG] (SEQ ID NO: 2029); and a sense strand comprising the nucleobase sequence of SEQ ID NO: 404 and a structure (5'→3') of (SEQ ID NO: 1202)
[[mUs]][[mUs]][[mG]][[mU]][[mC]][[mU]][[mA]][[mU]][[fG]][[fG]][[fC]][[fU]][[mU]][[mA]][[mU]][[mU]][[mC]][[mU]][[mU]][[mG]][[mAs]];

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage;

and wherein the 3' terminal nucleoside of the sense strand is covalently linked to a structure of Formula ($Z^6$)

($Z^6$)

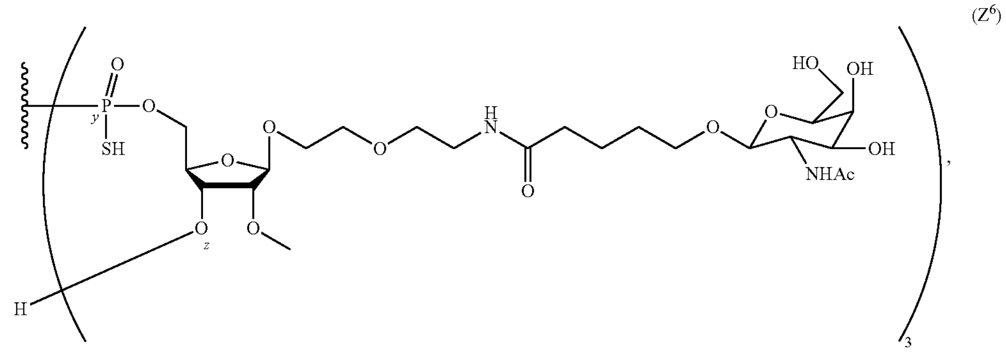

or a pharmaceutically acceptable salt thereof, wherein the

indicates the attachment point that is covalently linked to the 3'-O of the sugar moiety of the 3' terminal nucleoside of the sense strand. It is to be understood that the "s" of the 3'-terminal [mAs] of the sense strand corresponds to the phosphorothioate linkage (e.g.,

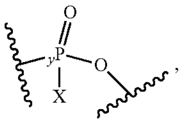

wherein X is —SH, i.e.,

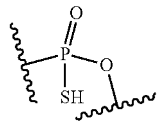

) of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formula ($Z^6$).

Further provided herein is an RNAi agent comprising:

an antisense strand comprising the nucleobase sequence of SEQ ID NO: 1181 and a structure (5'→3') of [mUs][fUs][fU][mC][fC][fG][fU][mG][mA][fG][mG][mG][mA][fA][mU][mU][mC][mA][mA][mG][mGs][mAs][mG] (SEQ ID NO: 2033); and a sense strand comprising the nucleobase sequence of SEQ ID NO: 464 and a structure (5'→3') of (SEQ ID NO: 1267)
[[mCs]][[mCs]][[mU]][[mU]][[mG]][[mA]][[mA]][[mU]][[fU]][[fC]][[fC]][[fC]][[mU]][[mC]][[mA]][[mC]][[mG]][[mG]][[mA]][[mA]][[mAs]];

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage;

and wherein the 3' terminal nucleoside of the sense strand is covalently linked to a structure of Formula ($Z^6$)

(Z$^6$)

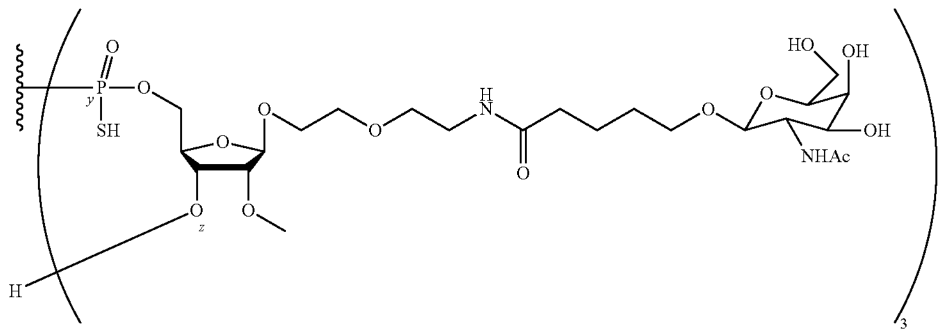

, or a pharmaceutically acceptable salt thereof, wherein the

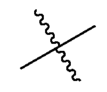

indicates the attachment point that is covalently linked to the 3'-O of the sugar moiety of the 3' terminal nucleoside of the sense strand. It is to be understood that the "s" of the 3'-terminal [mAs] of the sense strand corresponds to the phosphorothioate linkage (e.g.,

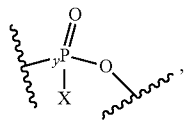

, wherein X is —SH, i.e.,

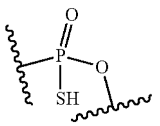

)

of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formula (Z$^6$).

Other aspects of the present disclosure provide pharmaceutical composition for inhibiting expression of a gene encoding CYP7A1 comprising the RNAi agent described herein.

Other aspects of the present disclosure provide methods of inhibiting expression of a CYP7A1 gene in a cell, the method comprising contacting the cell with the RNAi agent or the pharmaceutical composition provided herein, thereby inhibiting expression of the CYP7A1 gene in the cell. In some embodiments, the cell is within a subject, optionally wherein the subject is human. In some embodiments, the subject has a CYP7A1 disease or CYP7A1-associated disease.

Other aspects of the present disclosure provide methods of treating a subject having a CYP7A1 disease or CYP7A1-associated disease, comprising administering to the subject a therapeutically effective amount of the RNAi agent or the pharmaceutical composition provided herein, thereby treating the subject having the CYP7A1 disease or CYP7A1-associated disease.

Other aspects of the present disclosure provide methods of treating at least one symptom in a subject having a CYP7A1 disease or CYP7A1-associated disease, comprising administering to the subject an effective amount of the RNAi agent or the pharmaceutical composition provided herein, thereby treating at least one symptom in the subject having the CYP7A1 disease or CYP7A1-associated disease, optionally wherein the CYP7A1 disease or CYP7A1-associated disease is a liver disease. In some embodiments, the CYP7A1 disease or CYP7A1-associated disease is a cholestatic liver diseases such as primary sclerosing cholangitis (PSC). In some embodiments, the subject is human. In some embodiments, the method further comprises administering an agent for the treatment of a CYP7A1 disease or CYP7A1-associated disease.

BRIEF DESCRIPTION OF DRAWINGS

The foregoing and other features and advantages of the present invention, as well as the invention itself, will be more fully understood from the following description of embodiments when read together with the accompanying drawings, in which:

FIG. 1 is a schematic that illustrates 4 modification patterns (MOD 1, MOD 2, MOD 3, and MOD 4) used in siRNA synthesized for in vivo study. As used in FIG. 1, mN=a 2'-O-methyl (2'-O-Me) modified nucleoside, fN=a 2'-fluoro (2'-F) modified nucleoside, The bolded "|" between two nucleosides means phosphorothioate internucleoside linkage. Chemically modified siRNAs having the modification patterns illustrated in FIG. 1 may further be conjugated to targeting moieties (e.g., targeting moieties comprising GalNAc). For example, the targeting moiety having a structure of Formula (Z$^6$) may be conjugated to the 3' end nucleoside of the sense strand of such an siRNA.

DETAILED DESCRIPTION OF INVENTION

Unless otherwise defined herein, scientific and technical terms used herein have the meanings that are commonly understood by those of ordinary skill in the art. In the event of any latent ambiguity, definitions provided herein take precedence over any dictionary or extrinsic definition. Unless otherwise required by context, singular terms shall include pluralities and plural terms shall include the singular. The use of "or" means "and/or" unless stated otherwise. The use of the term "including", as well as other forms of the term, is not limiting.

Generally, nomenclatures used in connection with cell and tissue culture, molecular biology, immunology, microbiology, genetics and protein and nucleic acid chemistry and hybridization described herein are those well-known and commonly used in the art. The methods and techniques provided herein are generally performed according to conventional methods well known in the art and as described in various general and more specific references that are cited and discussed throughout the present specification unless otherwise indicated. Enzymatic reactions and purification techniques are performed according to manufacturer's specifications, as commonly accomplished in the art or as otherwise described herein. The nomenclatures, laboratory procedures and techniques of analytical chemistry, synthetic organic chemistry, and medicinal and pharmaceutical chemistry described herein are those well-known and commonly used in the art. Standard techniques are used for chemical syntheses, chemical analyses, pharmaceutical preparation, formulation, delivery, and treatment of patients. Any of the methods for gene therapy available in the art can be used in the methods provided herein. For general reviews of the methods of gene therapy, see Goldspiel et al. (1993) Clin. Pharmacy 12:488-505; Wu and Wu (1991) Biotherapy 3:87-95; Tolstoshev (1993) Ann. Rev. Pharmacol. Toxicol. 32:573-596; Mulligan (1993) Science 260:926-932; Morgan and Anderson (1993) Ann. Rev. Biochem. 62:191-217; and May (1993) TIBTECH 11(5):155-215. Methods commonly known in the art of recombinant DNA technology which can be used are described in Ausubel et al. (eds.), Current Protocols in Molecular Biology, John Wiley & Sons, NY (1993); and Kriegler, Gene Transfer and Expression, A Laboratory Manual, Stockton Press, NY (1990). Detailed-description of various methods of gene therapy are disclosed in US Patent Publication No. US20050042664.

Definitions

In order that the present disclosure may be more readily understood, certain terms are first defined. Unless otherwise defined herein, scientific and technical terms used in connection with the present disclosure shall have the meanings that are commonly understood by those of ordinary skill in the art. The meaning and scope of the terms should be clear, however, in the event of any latent ambiguity, definitions provided herein take precedent over any dictionary or extrinsic definition.

In addition, it should be noted that whenever a value or range of values of a parameter are recited, it is intended that values and ranges intermediate to the recited values are also part of this disclosure.

As used herein, the singular forms "a", "an" and "the" include plural referents unless the context clearly dictates otherwise. "And" as used herein is interchangeably used with "or" unless expressly stated otherwise. The terms "comprising, "having," "including," and "containing" are to be construed as open-ended terms (i.e., meaning "including, but not limited to") unless otherwise noted. Recitation of ranges of values herein are merely intended to serve as a shorthand method of referring individually to each separate value recited or falling within the range, unless otherwise indicated herein, and each separate value is incorporated into the specification as if it were individually recited.

The term "about" or "approximately," as applied to one or more values provided herein, refers to a value that is similar to a stated reference value. In some embodiments, the term "about" or "approximately" refers to a range of values that fall within and include 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context. In some embodiments, "about" or "approximately" can be understood as about 2 standard deviations from the mean. In some embodiments, "about" or "approximately" means up to and including ±10% (e.g., ±10%, ±9%, ±8%, ±7%, ±6%, ±5%, ±4%, ±3%, ±2%, ±1%, or less). In some embodiments, "about" or "approximately" means ±5%. When "about" or "approximately" is present before a series of numbers or a range, it is understood that it can modify each of the numbers in the series or range.

The term "administering" or "administration of," as used herein, means to provide an agent, e.g., RNAi agent or conjugate to a subject. In some embodiments, "administering" or "administration of" means to provide an RNAi agent or conjugate to a subject in a manner that is physiologically and/or (e.g., and) pharmacologically useful (e.g., to treat a condition in the subject). Non-limiting examples of routes of administration include intravenous, intramuscular, intraperitoneal, intracerebrospinal, subcutaneous, intra-articular, intrasynovial, or intrathecal routes. In some embodiments, the route of administration is subcutaneous.

The term "antisense strand" or "guide strand," as used herein, refers to a single stranded nucleic acid molecule, which is one strand of a double stranded RNAi molecule, and which comprises a region of complementarity to a target sequence (e.g., a target gene sequence, RNA sequence, or mRNA sequence). The antisense strand may contain modified nucleosides with base analogs and is not necessarily 100% complementary over its entire length to the target sequence, but must at least be sufficiently complementary to hybridize with a target RNA and result in RNA interference.

The term "at least" prior to a number or series of numbers is understood to include the number adjacent to the term "at least", and all subsequent numbers or integers that could logically be included, as clear from context. For example, the number of nucleotides or nucleosides in a nucleic acid molecule must be an integer. For example, "at least 19 nucleotides of a 21 nucleotide nucleic acid molecule" means that 19, 20, or 21 nucleotides have the indicated property. When at least is present before a series of numbers or a range, it is understood that "at least" can modify each of the numbers in the series or range.

The term "biological activity" means any biological property of a molecule, whether present naturally in vivo, or provided or enabled by recombinant means. Biological activities include, but are not limited to, binding to a receptor, inducing cell proliferation, inhibiting cell growth, inducing other cytokines, inducing apoptosis, and enzymatic activity.

"Blunt" or "blunt end" means that there are no unpaired nucleosides at that end of a double stranded RNAi agent, i.e., no nucleoside overhang. A "blunt ended" double stranded RNAi agent is double stranded over its entire length, i.e., no nucleoside overhang at either end of the molecule. The RNAi agents of the disclosure include RNAi agents with no nucleoside overhang at one end (i.e., agents with one overhang and one blunt end) or with no nucleoside overhangs at either end.

The term "complementary," as used herein, refers to the capacity for base pairing between two nucleobases or two nucleobase sequences. In particular, complementary is a term that characterizes an extent of hydrogen bond pairing that brings about binding between two nucleobases or two nucleobase sequences. For example, if a base at one position of a nucleobase sequence (e.g., antisense strand of an RNAi agent) is capable of hydrogen bonding with a base at the corresponding position of another nucleobase sequence (e.g., RNAi agent sense strand or target mRNA), then the bases are considered to be complementary to each other at that position. The nucleic acid molecules (e.g., antisense strand and sense strand of an RNAi agent) whose nucleobase sequences are complementary may comprise one or more modified nucleosides and modified internucleoside linkages, which do not affect the capacity of base paring between the nucleobases and do not affect the “complementarity” between two nucleobase sequences. The nucleic acid molecules (e.g., antisense strand and sense strand of an RNAi agent) whose nucleobase sequences are complementary may also comprise nucleobase analogous that result in bases at certain positions not being complementary, but the nucleobase sequences of the two molecules must be sufficiently complementary over the entire length to result in a desired biological activity (e.g., RNA interference).

Complementary sequences include Watson-Crick base pairs or non-Watson-Crick base pairs (e.g., Wobble base pairs and Hoogsteen base pairs) and may include natural or modified nucleosides or nucleoside mimics. For example, in some embodiments, for complementary base pairings, adenosine-type bases (A) are complementary to thymidine-type bases (T) or uracil-type bases (U), that cytosine-type bases (C) are complementary to guanosine-type bases (G), and that universal bases such as 3-nitropyrrole or 5-nitroindole can hybridize to and are considered complementary to any A, C, U, or T. Inosine (I) has also been considered in the art to be a universal base and is considered complementary to any A, C, U or T.

Complementarity is independent of modifications in the sugar of a nucleoside. For example, 2'-modified A, as defined herein, are complementary to U (or T) and identical to A for the purposes of determining identity or complementarity.

The term “perfectly complementary” or “fully complementary” means that all (100%) of the nucleobases, nucleosides, or nucleotides in a contiguous sequence of a first nucleotide sequence (e.g., antisense strand of an RNAi agent) will hybridize with the same number of nucleobases, nucleosides, or nucleotides in a contiguous sequence of second nucleotide sequence (e.g., RNAi agent sense strand or target mRNA). The contiguous sequence may comprise all or a part of a first or second nucleotide sequence. The term “partially complementary” means that in a hybridized pair of nucleobase, nucleosides, or nucleotide sequences, at least 70%, but not all, of the bases in a contiguous sequence of a first nucleotide sequence (e.g., antisense strand of an RNAi agent) will hybridize with the same number of bases in a contiguous sequence of a second nucleotide sequence (e.g., RNAi agent sense strand or target mRNA). The term “sufficiently complementary” or “substantially complementary” means that in a hybridized pair of nucleobase, nucleosides, or nucleotide sequences, at least 85%, but not all, of the bases in a contiguous sequence of a first nucleotide sequence (e.g., antisense strand of an RNAi agent) will hybridize with the same number of bases in a contiguous sequence of a second nucleotide sequence (e.g., RNAi agent sense strand or target mRNA). The terms “complementary,” “fully complementary,” “partially complementary,” and “sufficiently/substantially complementary” herein are used with respect to the nucleobase, nucleosides, or nucleotide matching between the sense strand and the antisense strand of an RNAi agent, or between the antisense strand of an RNAi agent and a target mRNA sequence (e.g., CYP7A1 mRNA).

The term “conjugate,” as used herein, refers to an RNAi agent described herein (e.g., a CYP7A1 RNAi agent) linked (e.g., covalently linked) to a conjugate group (e.g., a targeting moiety). In general, conjugate groups modify one or more properties of the RNAi agent to which they are attached, including, but not limited to pharmacodynamic, pharmacokinetic, binding, absorption, cellular distribution, cellular uptake, charge and/or clearance properties.

The term “contiguous” in the context of an oligonucleotide (e.g., RNAi agent) refers to nucleosides, nucleobases, sugar moieties, or internucleoside linkages that are immediately adjacent to each other. For example, “contiguous nucleobases” means nucleobases that are immediately adjacent to each other in a sequence.

The term “control” or “reference,” when referring to a substance, means a composition used as a standard or a point of comparison against which other test results are measured. In some embodiments, a “control” or “reference” is a composition known to not contain analyte (“negative control”) or to contain analyte (“positive control”). A positive control can comprise a known concentration of analyte. “Control,” and “positive control,” may be used to refer to a composition comprising a known concentration of analyte. A “positive control” can be used to establish assay performance characteristics and is a useful indicator of the integrity of reagents (e.g., analytes). In some embodiments, an appropriate “control” or “reference” is where only one element is changed in order to determine the effect of the one element. In some embodiments, a control is a level of a target gene (e.g., in a cell or in a subject) before treatment (e.g., with an RNAi agent described herein).

The term “control” or “reference” also means a baseline level of a measurement depending upon the context, in which the term is used. A baseline level of a measurement is a standard or a point of comparison against which the measurement is compared. In some embodiments, a “control” or a “reference” refers to a level of a measurement for certain biological activity or substance in a cell, a tissue, an organ, or a subject, e.g., the expression level of a gene, copy number of mRNA for such gene, or level of protein encoded by such gene, without treatment of the cell, the tissue, the organ, or the subject, with an agent, e.g., an RNAi agent. In some embodiments, a “control” or a “reference” refers to a level of an average measurement for a certain biological activity or substance in a cell, a tissue, an organ, or a subject, e.g., certain enzyme activity of the liver, among a group of healthy subjects, e.g., the general population within in certain geographic or demographic limits or any other limits that may be appropriate for the study of certain disease or disorder, that does not have certain disease or disorder, e.g., liver disease.

The term “reference” may also be used in “reference sequence.” The term “reference sequence” refers to a sequence, e.g., a nucleic acid sequence or an amino acid sequence, used as a basis for sequence comparison. In certain embodiments, a reference sequence is the mRNA sequence, e.g., human CYP7A1 mRNA sequence (NM_000780.4, SEQ ID NO: 1), upon which the design of the siRNA is based.

The term “cross-reactive” means the ability of a binding molecule (e.g., an RNAi agent) to bind a target molecule (e.g., an mRNA) other than that against which it was designed or generated. For example, the binding molecule is capable of specifically binding to more than one target molecule of a similar type or class (e.g., mRNA variants or mRNA homologus from closely related species) with similar affinity. Generally, a binding molecule will bind its target molecule with an appropriately high affinity, but can bind to the same target molecule of another species or display a low affinity for non-target molecules. In some embodiments, an RNAi agent that is cross-reactive against human and non-human primate CYP7A1 comprises an antisense strand comprising a region of complementarity to human and non-human primate CYP7A1 mRNA, and/or inhibits the expression of human and non-human primate CYP7A1. Individual binding molecules are generally selected to meet two criteria: (1) tissue staining appropriate for the known expression of the target or (2) similar staining pattern between human and tox species (mouse and cynomolgus monkey) tissues from the same organ. These and other methods of assessing cross-reactivity are known to one skilled in the art.

The term "effective amount" or "therapeutically effective amount," as used herein, refers to that amount of an RNAi agent to produce a molecular (e.g., reduced expression of CYP7A1), biological (e.g., reduced accumulation of toxic bile acids), pharmacological, therapeutic (e.g., treatment of a CYP7A1 associated disease), or preventive result. The amount administered will likely depend on such variables as the overall health status of the patient, the relative biological efficacy of the compound delivered, the formulation of the drug, the presence and types of excipients in the formulation, and the route of administration. Also, it is to be understood that the initial dosage administered can, in some instances, be increased beyond the above upper level to rapidly achieve the desired blood-level or tissue level, or the initial dosage can, in some instances, be smaller than the optimum.

The term "GalNAc" refers to N-Acetylgalactosamine (GalNAc), which is a monosaccharide and amino sugar derivative of galactose. GalNAc may also be referred to in the art as 2-(Acetylamino)-2-deoxy-D-galactopyranose, 2-(Acetylamino)-2-deoxy-D-galactose, N-Acetylchondrosamine, and N-Acetyl-D-galactosamine. Galactose derivatives such as GalNAc have been used to target molecules to hepatocytes in vivo through their binding to the asialoglycoprotein receptor expressed on the surface of hepatocytes. Binding of asialoglycoprotein receptor ligands to the asialoglycoprotein receptor(s) facilitates cell-specific targeting to target cells (e.g., hepatocytes) and endocytosis of the molecule into the target cells (e.g., hepatocytes). In some embodiments, any one of the targeting moieties described herein includes an asialoglycoprotein receptor ligand comprising GalNAc. In some embodiments, the asialoglycoprotein receptor ligand comprises a GalNAc trimer. Asialoglycoprotein receptor ligands can be monomeric (e.g., having a single GalNAc) or multimeric (e.g., having multiple GalNAcs). The targeting moiety may comprise one or more GalNAcs attached to the 3' or 5' end of the sense or antisense strand of the RNAi agent using methods known in the art. In some embodiments, the targeting moiety comprises one or more (e.g., 1, 2, 3, 4, or more) GalNAc, each of which are linked via phosphorothioate linkages. GalNAc targeting moieties, which comprise one or more GalNAc, have been described, for example, in the following references:

| Reference No. | Application No. | Filing Date |
|---|---|---|
| U.S. Pat. No. 8,106,022 | U.S. Pat. No. 12/328,528 | Dec. 4, 2008 |
| U.S. Pat. No. 10,246,709 | U.S. Pat. No. 15/452,423 | Mar. 7, 2017 |
| U.S. Pat. No. 5,994,517 | U.S. Pat. No. 08/755,062 | Nov. 22, 1996 |
| U.S. Pat. No. 6,906,182 | U.S. Pat. No. 09/998,497 | Nov. 30, 2001 |

-continued

| Reference No. | Application No. | Filing Date |
|---|---|---|
| U.S. Pat. No. 10,294,474 | U.S. Pat. No. 15/452,324 | Mar. 7, 2017 |
| U.S. Pat. No. 2017305956 | U.S. Pat. No. 15/621,395 | Jun. 13, 2017 |
| U.S. Pat. No. 10,233,448 | U.S. Pat. No. 15/504,855 | Feb. 17, 2017 |
| U.S. Pat. No. 2016122761 | U.S. Pat. No. 14/898,873 | Jun. 23, 2014 |
| U.S. Pat. No. 10,808,246 | U.S. Pat. No. 14/901,945 | Dec. 29, 2015 |
| WO 2022/159158A1 | PCT/US2021/057016 | Oct. 28, 2021 |

The disclosures in these references related to GalNAc are hereby incorporated herein by reference.

The terms "hybridize" and "hybridization" refer to the pairing of complementary compounds (e.g., an RNAi agent and its target nucleic acid). While not limited to a particular mechanism, the most common mechanism of pairing involves hydrogen bonding, which may be Watson-Crick, Wobble, Hoogsteen or reversed Hoogsteen hydrogen bonding, between complementary nucleobases.

The term "internucleoside linkage," as used herein, means a covalent linkage between adjacent nucleosides in an oligonucleotide (e.g., RNAi agent such as a CYP7A1 RNAi agent described herein). An internucleoside linkage may be a natural phosphodiester internucleoside linkage, or may be a modified (non-natural) internucleoside linkage. Modified internucleoside that may be used in an RNAi agent disclosed herein include, but are not limited to, phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, mesyl phosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'; see U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; and 5,625,050.

The term "linker" in the context of a conjugate refers to a bond (e.g., covalent bond) or chemical moiety between two components of the conjugate, e.g., between an RNAi agent and a targeting moiety. In some embodiments, the linker facilitates covalent linkage of an RNAi agent to a targeting moiety. In some embodiments, the linker is conjugated to the 5' or 3'end of the sense strand or antisense strand of an RNAi agent. In some embodiments, the linker is conjugated to the 5' or 3' end the sense strand of an RNAi agent. In some embodiments, a linker is conjugated to the 5' end of the sense strand of an RNAi agent. In some embodiments, a linker is conjugated to the 3' end of the sense strand of an RNAi agent. The linker can be any suitable group for coupling the RNAi agent to the ligand. In some embodiments, the linker is a monovalent, bivalent, trivalent, or tetravalent branched linker. In some embodiments, the linker is a phosphorus-containing linker (e.g., phosphate, phosphodiester, phosphorothioate, phosphorodithioate, phosphoroamidate, etc), or other linker. Non-limiting examples of other linkers can include, but are not limited to: reactive groups such a primary amines and alkynes, alkyl groups, abasic nucleotides, ribitol (abasic ribose), and/or PEG groups. In some embodiments, the linker is a phosphorothioate linkage.

The term, "nucleoside," as used herein, refers to a compound comprising a nucleobase moiety and a sugar moiety. Nucleosides include, but are not limited to, naturally occurring nucleosides (as found in DNA and RNA) and modified nucleosides. Nucleosides may be linked to a phosphate moiety. The term "nucleoside" encompasses a natural nucleoside and chemically modified nucleosides (e.g., with modifications in the base and/or sugar moiety).

The term "nucleotide," as used herein, refers to a compound comprising a nucleoside linked to a phosphate group. As used herein, "linked nucleosides" may or may not be linked by phosphate linkages and thus includes, but is not limited to "linked nucleotides." As used herein, "linked nucleosides" are nucleosides that are connected in a continuous sequence (i.e., no additional nucleosides are present between those that are linked). The term "nucleotide" encompasses a natural nucleotide and chemically modified nucleotides (e.g., with modifications in the base, sugar moiety, and/or phosphate group).

The term "nucleobase," as used herein, refers to nitrogen-containing compounds that can be linked to a sugar moiety to create a nucleoside that is capable of incorporation into an oligonucleotide, and wherein the compound is capable of bonding with a complementary naturally occurring nucleobase of another oligonucleotide or nucleic acid. Nucleobases may be naturally occurring or may be modified. As used herein a "naturally occurring nucleobase" is adenine (A), thymine (T), cytosine (C), uracil (U), and guanine (G). The term "nucleobase" encompasses 5'-methylated bases (e.g., 5'-methyl cytosine or 5'-methyl guanine).

The term "modified internucleoside linkage" refers to a linkage between two nucleosides (e.g., in an oligonucleotide or in a strand of an RNAi agent) that is not the natural phosphodiester linkage. Non-limiting examples of modified internucleoside linkages include phosphorothioates, phosphorodiamidates, phosphotriesters, methyl phosphonates, short chain alkyl or cycloalkyl intersugar linkages or short chain heteroatomic or heterocyclic intersugar linkages.

The term "nucleoside modification" or "modified nucleoside" means a nucleoside that has one or more modifications to the nucleoside, including modifications to the nucleobase moiety and/or the sugar moiety. Any of the modified chemistries or formats of nucleosides described herein can be combined with each other. Non-limiting examples of modified nucleosides includes 2'-fluoro (2'-F), 2'-O-methyl (2'-O-Me), 2'-O-methoxyethyl (2'-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O-NMA), locked nucleic acid (LNA, methylene-bridged nucleic acid), unlocked nucleic acid (UNA), ethylene-bridged nucleic acid (ENA), and (S)-constrained ethyl-bridged nucleic acid (cEt) modified nucleosides. Further non-limiting examples of modified nucleosides include a conformationally restricted nucleoside, an abasic nucleoside, a 2'-amino-modified nucleoside, a morpholino nucleoside, a phosphoramidate, a non-natural base comprising nucleoside, a tetrahydropyran modified nucleoside, a 1,5-anhydrohexitol modified nucleoside (HNA), a cyclohexenyl modified nucleoside (CeNA), a nucleoside comprising a phosphorothioate group, a nucleoside comprising a methylphosphonate group, a nucleoside comprising a 5'-phosphate, a nucleoside comprising a 5'-phosphate mimic, a thermally destabilizing nucleoside, a glycol modified nucleoside (GNA).

The term "2'-modified nucleoside" refers to a nucleoside having a sugar moiety modified at the 2' position, meaning the sugar moiety comprises at least one 2'-substituent group other than H or OH. Non-limiting examples of 2'-modified nucleosides include: 2'-fluoro (2'-F), 2'-O-methyl (2'-O-Me), 2'-O-methoxyethyl (2'-MOE), 2'-deoxy, 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O-NMA) modified nucleosides. In some embodiments, any one of the 2'-modified nucleosides described herein are high-affinity modified nucleosides and a modified RNAi agent has increased affinity to target sequences, relative to an unmodified RNAi agent. In some embodiments, at least one modified nucleoside is a 2' modified nucleoside. In some embodiments the 2' modified nucleoside is a 2'-O-methyl (2'-O-Me) modified nucleoside or a 2'-fluoro (2'-F) modified nucleoside or combinations thereof.

The term "modified oligonucleotide" or "modified RNAi agent" or "modified siRNA" refers to oligonucleotides, modified RNAi agents, or modified siRNAs that comprise one or more modified nucleosides and/or one or more modified internucleoside linkages. In some embodiments, a "modified oligonucleotide" or "modified RNAi agent" or "modified siRNA" comprises a mix of modified nucleosides and unmodified nucleosides and/or a mix of modified internucleoside linkages and unmodified modified internucleoside linkages. In some embodiments, each nucleoside of a modified, oligonucleotide" or "modified RNAi agent" or "modified siRNA" is a modified nucleoside, and/or each internucleoside linkage of a modified oligonucleotide" or "modified RNAi agent" or "modified siRNA" is a modified internucleoside linkage.

As used herein, the term "nucleoside overhang" or "overhang" refers to at least one unpaired nucleoside that protrudes from the duplex structure of an RNAi agent. For example, when a 3'-end of one strand of an RNAi agent extends beyond the 5'-end of the other strand, or vice versa, there is a nucleoside overhang. An RNAi agent can comprise an overhang of at least one nucleoside, at least two nucleosides, at least three nucleosides, at least four nucleosides, or more. The overhang(s) can be on the sense strand, the antisense strand, or any combination thereof. Furthermore, the nucleoside(s) of an overhang can be present on the 5'-end, 3'-end, or both ends of either an antisense or sense strand of an RNAi agent.

In some embodiments, at least one strand of an RNAi agent comprises a 3' overhang of at least 1 nucleoside. In some embodiments, at least one strand comprises a 3' overhang of at least 2 nucleosides, e.g., 2, 3, 4, 5, etc. nucleosides. In some embodiments, at least one strand of an RNAi agent comprises a 5' overhang of at least 1 nucleoside. In some embodiments, at least one strand comprises a 5' overhang of at least 2 nucleosides, e.g., 2, 3, 4, 5, etc. nucleosides. In some embodiments, both the 3' and the 5' end of one strand of an RNAi agent comprise an overhang of at least 1 nucleoside.

In some embodiments, the antisense strand of an RNAi agent has a 1-10 nucleoside, e.g., a 1, 2, 3, 4, 5, 6, 7, 8, 9, or 10 nucleoside, overhang at the 3'-end or the 5'-end. In some embodiments, the sense strand of an RNAi agent has a 1-10 nucleoside, e.g., a 1, 2, 3, 4, 5, 6, 7, 8, 9, or 10 nucleoside, overhang at the 3'-end or the 5'-end. In another embodiment, one or more of the nucleosides in the overhang is replaced with a nucleoside thiophosphate.

In some embodiments, the antisense strand of an RNAi agent has a 1-10 nucleosides, e.g., a 1, 2, 3, 4, 5, 6, 7, 8, 9, or 10 nucleoside, overhang at the 3'-end or the 5'-end. In some embodiments, the antisense strand of an RNAi agent has a 1-3 nucleosides, e.g., a 1, 2, or 3 nucleoside, overhang at the 3'-end.

In some embodiments, the nucleosides in an overhang that is immediately adjacent to the duplex region is linked to the adjacent nucleoside in the duplex region via a phosphorothioate internucleoside linkage or a phosphodiester internucleoside linkage. In some embodiments, the overhang comprises two or more nucleosides and the nucleosides in an overhang are linked via a phosphorothioate internucleoside linkage or a phosphodiester internucleoside linkage.

The term "passenger strand" or "sense strand," as used herein, refers to a single stranded nucleic acid molecule which is one strand of a double stranded RNAi molecule, and which has a sequence that is at least substantially complementary (e.g., at least 85% complementary) to that of the guide strand/antisense strand. The sense strand need not be fully complementary over the entire length of the antisense strand, but must at least be sufficiently complementary to hybridize with the antisense strand and result in RNA interference.

The term "repeat unit" refers to a part of a compound whose repetition would produce the complete compound (except for the end-groups, e.g., the RNAi agent and $R^4$ as disclosed herein) by linking the repeat units together successively along the chain.

The term "region of complementarity," as used herein, refers to a nucleobase sequence, e.g., of an RNAi agent, that is sufficiently complementary to a cognate nucleobase sequence, e.g., of a target nucleic acid, such that the two nucleobase sequences are capable of annealing to one another under physiological conditions (e.g., in a cell). In some embodiments, a region of complementarity is fully complementary to a cognate nucleobase sequence of target nucleic acid. However, in some embodiments, a region of complementarity is partially complementary to a cognate nucleobase sequence of target nucleic acid (e.g., at least 80%, 90%, 95% or 99% complementarity). In some embodiments, a region of complementarity contains 1, 2, 3, 4, or 5 mismatches compared with a cognate nucleobase sequence of a target nucleic acid.

The term "RNAi agent," or "RNA interference agent" means a composition that contains an RNA or RNA-like (e.g., chemically modified RNA) oligonucleotide molecule that is capable of degrading or inhibiting translation of messenger RNA (mRNA) transcripts of a target mRNA in a sequence specific manner. As used herein, RNAi agents may operate through the RNA interference mechanism (i.e., inducing RNA interference through interaction with the RNA interference pathway machinery (RNA-induced silencing complex or RISC) of mammalian cells), or by any alternative mechanism(s) or pathway(s). While it is believed that RNAi agents, as that term is used herein, operate primarily through the RNA interference mechanism, the disclosed RNAi agents are not bound by or limited to any particular pathway or mechanism of action. An RNAi agent modulates, e.g., inhibits, the expression of a CYP7A1 in a cell, e.g., a cell within a subject, such as a mammalian subject. RNAi agents include, but are not limited to: single-stranded oligonucleotides, single-stranded antisense oligonucleotides, short interfering RNAs (siRNAs), double-strand RNAs (dsRNA), micro RNAs (miRNAs), short hairpin RNAs (shRNA), and dicer substrates. Any one of the RNAi agents described herein comprises a strand that is at least partially complementary to the mRNA being targeted. In some embodiments, an RNAi agent is single stranded (e.g., it can be an antisense oligonucleotide). In some embodiments, an RNAi agent is double stranded. In some embodiments, the double stranded RNAi agent is a double stranded siRNA.

In some embodiments, an RNAi agent described herein is double-stranded, and comprises an antisense strand and a sense strand, wherein the antisense strand is at least partially complementary to the mRNA being targeted (e.g., CYP7A1 mRNA), and the sense strand is at least partially complementary to the antisense strand. It is not necessary that there be perfect complementarity between the RNAi agent and the target, but the correspondence is preferably sufficient to enable the RNAi agent to direct sequence specific silencing, e.g., by RNAi cleavage of the target RNA, e.g., CYP7A1 mRNA. An RNAi agent described herein may comprise one or more modified nucleosides and/or one or more modified (e.g., non-phosphodiester) internucleoside linkages.

Modification to stabilize one or more 3'- or 5'-terminus of an RNAi agent, e.g., against exonucleases may also be present in an RNAi agent described herein. Other modifications can include C3 (or C6, C7, C12) amino linkers, thiol linkers, carboxyl linkers, non-nucleotidic spacers (C3, C6, C9, C12, abasic, triethylene glycol, hexaethylene glycol), special biotin or fluorescein reagents that come as phosphoramidites and that have another DMT-protected hydroxyl group, allowing multiple couplings during RNA synthesis. Modifications can also include, e.g., the use of modifications at the 2' OH group of the ribose sugar, e.g., the use of deoxyribonucleosides, e.g., deoxythymidine, instead of ribonucleosides, and modifications in the internucleoside linkages, e.g., phosphothioate internucleoside linkages. In some embodiments, the different strands will include different modifications. In some embodiments, an RNAi agent of the disclosure includes a short interfering RNA (siRNA) that interacts with a target RNA sequence, e.g., a CYP7A1 target sequence, to direct the cleavage of the target RNA. In some embodiments, an RNAi agent described herein is a small interfering RNA (siRNA).

The term "siRNA," as used herein, refers to a complex of ribonucleic acid molecules, having a duplex structure comprising two anti-parallel and substantially complementary (e.g., at least 85% complementary) nucleic acid strands, referred to as having "sense" and "antisense" orientations with respect to a target sequence, i.e., a CYP7A1 sequence. Each strand of the siRNA may optionally and independently comprise ribonucleosides (RNA), RNA analog(s) (e.g., chemically modified ribonucleosides), and/or deoxyribonucleosides (DNA). Each strand of an siRNA comprises between 15 and 30 nucleosides (e.g., 15, 16, 17, 18, 19, 20, 21, 22, 23, 24, 25, 26, 27, 28, 29, or 30 nucleosides). In some embodiments, each strand of an siRNA comprises between 18 and 28 nucleosides (e.g., 18-28, 19-25, 19-23, 19-21). In some embodiments, each strand of an siRNA is 19, 20, 21, 22, or 23 nucleosides in length. In some embodiments of the disclosure, an siRNA induces the degradation of a target RNA, e.g., an mRNA, through a post-transcriptional gene-silencing mechanism referred to herein as RNA interference or RNAi.

In some embodiments, any one of the CYP7A1 RNAi agents (e.g., siRNAs) disclosed herein comprises a duplex region of 10-30 base pairs in length (e.g., 10, 11, 12, 13, 14, 15, 16, 17, 18, 19, 20, 21, 22, 23, 24, 25, 26, 27, 28, 29, or 30 base pairs in length). In some embodiments, an RNAi agent of the present disclosure is blunt ended. In some embodiments, an RNAi agent of the present disclosure has overhangs on one or both strands. The overhang may include 1-10 (e.g., 1-10, 1-8, 1-5, 1-3, 1-2) nucleosides, such that the duplex region in the RNAi agent comprises 17-21 nucleosides, or 19 nucleosides. The overhangs can be the result of one strand being longer than the other, or the result of two strands of the same length being staggered.

Without wishing to be bound by theory, it is believed that long double stranded RNA introduced into cells is broken down into siRNA by a Type III endonuclease known as Dicer (Sharp et al. (2001) *Genes Dev.* 15:485). Dicer, a ribonuclease-III-like enzyme, processes the dsRNA into 19-23 base pair short interfering RNAs with characteristic two base 3' overhangs (Bernstein, et al., (2001) *Nature* 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188).

In one aspect, the disclosure relates to a single stranded RNA generated within a cell and which promotes the formation of a RISC complex to effect silencing of the target gene, i.e., CYP7A1 gene. In some embodiments, an RNAi agent may be a single-stranded RNA (ssRNAi) that is introduced into a cell or organism to inhibit a target mRNA. Single-stranded RNAi agents bind to the RISC endonuclease, Argonaute 2, which then cleaves the target mRNA. The single-stranded RNAi agents are generally 15-30 nucleosides and may be chemically modified. The design and testing of single-stranded RNAi agents are described in U.S. Pat. No. 8,101,348 and in Lima et al., (2012) *Cell* 150:883-894, the entire contents of each of which are hereby incorporated herein by reference.

The term "sequence identity," as used herein, refers to the extent that sequences are identical (independent of chemical modification) on a nucleobase-by-nucleobase basis or an amino acid-by-amino acid basis over a window of comparison. Thus, a "percentage of sequence identity" may be calculated by comparing two optimally aligned sequences over the window of comparison, determining the number of positions at which the identical nucleic acid base (e.g., A, T, C, G, I) or the identical amino acid residue (e.g., Ala, Pro, Ser, Thr, Gly, Val, Leu, Ile, Phe, Tyr, Trp, Lys, Arg, His, Asp, Glu, Asn, Gln, Cys and Met) occurs in both sequences to yield the number of matched positions, dividing the number of matched positions by the total number of positions in the window of comparison (i.e., the window size), and multiplying the result by 100 to yield the percentage of sequence identity. Optimal alignment of sequences for aligning a comparison window may be conducted by computerized implementations of algorithms (GAP, BESTFIT, FASTA, and TFASTA in the Wisconsin Genetics Software Package Release 7.0, Genetics Computer Group, 575 Science Drive Madison, Wis., USA) or by inspection and the best alignment (i.e., resulting in the highest percentage homology over the comparison window) generated by any of the various methods selected. Reference also may be made to the BLAST family of programs as for example disclosed by Altschul et al., Nucl. Acids Res. 25:3389, 1997.

The terms "silence," "reduce," "inhibit," "down-regulate," or "knockdown" when referring to expression of a given gene (e.g., CYP7A1), mean that the expression of the gene, as measured by the level of RNA transcribed from the gene or the level of polypeptide, protein or protein subunit translated from the mRNA in a cell, group of cells, tissue, organ, or subject in which the gene is transcribed, is reduced when the cell, group of cells, tissue, organ, or subject is treated with an RNAi agent or conjugate described herein as compared to a control or reference cell, group of cells, tissue, organ or a subject, e.g., a second cell, group of cells, tissue, organ, or subject that has not or have not been so treated. In some embodiments, when a cell, group of cells, tissue, organ, or subject is treated with an RNAi agent or conjugate described herein, expression of a target gene (e.g., CYP7A1) is reduced by at least 10%, at least 20%, at least 30%, at least 40%, at least 50%, at least 60%, at least 70%, at least 80%, at least 90% or at least 95% relative to a control, e.g., baseline level of gene expression prior to treatment.

The term "subject," as used herein, refers to a mammal. In some embodiments, a subject is non-human primate, or rodent. In some embodiments, a subject is a human. In some embodiments, a subject is a patient, e.g., a human patient that has or is suspected of having a disease. In some embodiments, the subject is a human patient who has or is suspected of having a CYP7A1 disease or CYP7A1-associated disease.

The term "specificity" means the ability to inhibit the target RNA without manifest effects on other genes of the cell. The consequences of inhibition can be confirmed by examination of the outward properties of the cell or organism or by biochemical techniques such as RNA solution hybridization, nuclease protection, Northern hybridization, reverse transcription, gene expression monitoring with a microarray, antibody binding, enzyme linked immunosorbent assay (ELISA), Western blotting, radioimmunoassay (RIA), other immunoassays, and fluorescence activated cell analysis (FACS).

The term "symptom" as used herein, refers to any manifestation or indication of an underly disease. A symptom can be any biochemical, cellular, genetic, histological, and/or physiological observation, measurement, and/or test result in a subject that deviate from those of a control or reference. For example, a symptom may be an elevated level of a liver enzyme, such as aminotransferases, as compared to a normal reference range.

The term "target sequence," as used herein, refers to a nucleoside sequence whose expression or activity is to be modulated. In some embodiments, the target sequence is a contiguous portion of the nucleoside sequence of a gene, a cDNA, or an mRNA molecule formed during the transcription of a target gene, e.g., CYP7A1 gene, including a unprocessed pre-mRNA transcript and mRNA that is a product of RNA processing of a primary transcription product. The target portion of the sequence will be at least long enough to serve as a substrate for RNAi-directed cleavage at or near that portion of the nucleoside sequence of an mRNA molecule formed during the transcription of the target gene, e.g., CYP7A1 gene. In some embodiment, the target sequence is within the protein coding region of the target gene, e.g., CYP7A1.

The term "treat," "treatment," as used herein, mean the methods or steps taken to provide relief from or alleviation of the number, severity, and/or frequency of one or more symptoms of a disease (e.g., a CYP7A1 disease or CYP7A1-associated disease) in a subject. As used herein, "treat" and treatment" may include the prevention, management, prophylactic treatment, and/or inhibition of the number, severity, and/or frequency of one or more symptoms of a disease (e.g., a CYP7A1 disease or CYP7A1-associated disease) in a subject.

The term "variant" means a molecule (e.g., nucleic acid or polypeptide) that differs from a given molecule (e.g., a reference nucleic acid or polypeptide) in sequence (nucleic acid or amino acid respectively) by the addition (e.g., insertion), deletion, or conservative substitution of nucleic acids or amino acids, respectively, but that retains the biological activity of the given molecule. Nucleic acid variants are closely related overall and, in many regions, identical. Changes in the reference nucleic acid sequence of the variant may be silent. That is, they may not alter the amino acid sequence encoded by the nucleic acid. Alternatively, changes in the nucleoside sequence of the variant may alter the amino acid sequence of a polypeptide encoded by the reference polynucleotide. Such nucleoside changes may result in amino acid substitutions, additions, deletions, fusions, and truncations in the polypeptide encoded by the reference sequence. The term "variant" encompasses fragments of a variant unless otherwise defined. A variant may be 99%, 98%, 97%, 96%, 95%, 94%, 93%, 92%, 91%, 90%, 89%, 88%, 87%, 86%, 85%, 84%, 83%, 82%, 81%, 80%, 79%, 78%, 77%, 76%, or 75% identical to the reference sequence. The degree of homology (percent identity) between a native and a variant sequence can be determined, for example, by comparing the two sequences using freely available computer programs commonly employed for this purpose on the world wide web (e.g., BLASTn with default settings).

Definitions of specific functional groups and chemical terms are described in more detail below. The chemical elements are identified in accordance with the Periodic Table of the Elements, CAS version, *Handbook of Chemistry and Physics*, 75$^{th}$ Ed., inside cover, and specific functional groups are generally defined as described therein. Additionally, general principles of organic chemistry, as well as specific functional moieties and reactivity, are described in *Organic Chemistry*, Thomas Sorrell, University Science Books, Sausalito, 1999; Smith and March, *March's Advanced Organic Chemistry*, 5$^{th}$ Edition, John Wiley & Sons, Inc., New York, 2001; Larock, *Comprehensive Organic Transformations*, VCH Publishers, Inc., New York, 1989; and Carruthers, *Some Modern Methods of Organic Synthesis*, 3$^{rd}$ Edition, Cambridge University Press, Cambridge, 1987.

Compounds described herein can comprise one or more asymmetric centers, and thus can exist in various stereoisomeric forms, e.g., enantiomers and/or diastereomers. For example, the compounds described herein can be in the form of an individual enantiomer, diastereomer or geometric isomer, or can be in the form of a mixture of stereoisomers, including racemic mixtures and mixtures enriched in one or more stereoisomer. Isomers can be isolated from mixtures by methods known to those skilled in the art, including chiral high pressure liquid chromatography (HPLC) and the formation and crystallization of chiral salts; or preferred isomers can be prepared by asymmetric syntheses. See, for example, Jacques et al., *Enantiomers, Racemates and Resolutions* (Wiley Interscience, New York, 1981); Wilen et al., *Tetrahedron* 33:2725 (1977); Eliel, E. L., *Stereochemistry of Carbon Compounds* (McGraw-Hill, NY, 1962); and Wilen, S. H., *Tables of Resolving Agents and Optical Resolutions* p. 268 (E. L. Eliel, Ed., Univ. of Notre Dame Press, Notre Dame, IN 1972). The invention additionally encompasses compounds as individual isomers substantially free of other isomers, and alternatively, as mixtures of various isomers.

In a formula,  is a single bond were the stereochemistry of the moieties immediately attached thereto is not specified,  is absent or a single bond, and  or  is a single or double bond.

Unless otherwise stated, structures depicted herein are also meant to include compounds that differ only in the presence of one or more isotopically enriched atoms. For example, compounds having the present structures except for the replacement of hydrogen by deuterium or tritium, replacement of $^{19}F$ with $^{18}F$, or the replacement of $^{12}C$ with $^{13}C$ or $^{14}C$ are within the scope of the disclosure. Such compounds are useful, for example, as analytical tools or probes in biological assays.

When a range of values is listed, it is intended to encompass each value and sub-range within the range. For example "$C_{1-6}$ alkyl" is intended to encompass, $C_1$, $C_2$, $C_3$, $C_4$, $C_5$, $C_6$, $C_{1-6}$, $C_{1-5}$, $C_{1-4}$, $C_{1-3}$, $C_{1-2}$, $C_{2-6}$, $C_{2-5}$, $C_{2-4}$, $C_{2-3}$, $C_{3-6}$, $C_{3-5}$, $C_{3-4}$, $C_{4-6}$, $C_{4-5}$, and $C_{5-6}$ alkyl.

The term "aliphatic" refers to alkyl, alkenyl, alkynyl, and carbocyclic groups. Likewise, the term "heteroaliphatic" refers to heteroalkyl, heteroalkenyl, heteroalkynyl, and heterocyclic groups.

The term "alkyl" refers to a radical of a straight-chain or branched saturated hydrocarbon group having from 1 to 10 carbon atoms ("$C_{1-10}$ alkyl"). In some embodiments, an alkyl group has 1 to 9 carbon atoms ("$C_{1-9}$ alkyl"). In some embodiments, an alkyl group has 1 to 8 carbon atoms ("$C_{1-8}$ alkyl"). In some embodiments, an alkyl group has 1 to 7 carbon atoms ("$C_{1-7}$ alkyl"). In some embodiments, an alkyl group has 1 to 6 carbon atoms ("$C_{1-6}$ alkyl"). In some embodiments, an alkyl group has 1 to 5 carbon atoms ("$C_{1-5}$ alkyl"). In some embodiments, an alkyl group has 1 to 4 carbon atoms ("$C_{1-4}$ alkyl"). In some embodiments, an alkyl group has 1 to 3 carbon atoms ("$C_{1-3}$ alkyl"). In some embodiments, an alkyl group has 1 to 2 carbon atoms ("$C_{1-2}$ alkyl"). In some embodiments, an alkyl group has 1 carbon atom ("$C_1$ alkyl"). In some embodiments, an alkyl group has 2 to 6 carbon atoms ("$C_{2-6}$ alkyl"). Examples of $C_{1-6}$ alkyl groups include methyl ($C_1$), ethyl ($C_2$), propyl ($C_3$) (e.g., n-propyl, isopropyl), butyl ($C_4$) (e.g., n-butyl, tert-butyl, sec-butyl, iso-butyl), pentyl ($C_5$) (e.g., n-pentyl, 3-pentanyl, amyl, neopentyl, 3-methyl-2-butanyl, tertiary amyl), and hexyl ($C_6$) (e.g., n-hexyl). Additional examples of alkyl groups include n-heptyl ($C_7$), n-octyl ($C_8$), and the like. Unless otherwise specified, each instance of an alkyl group is independently unsubstituted (an "unsubstituted alkyl") or substituted (a "substituted alkyl") with one or more substituents (e.g., halogen, such as F). In certain embodiments, the alkyl group is an unsubstituted $C_{1-10}$ alkyl (such as unsubstituted $C_{1-6}$ alkyl, e.g., —$CH_3$·(Me), unsubstituted ethyl (Et), unsubstituted propyl (Pr, e.g., unsubstituted n-propyl (n-Pr), unsubstituted isopropyl (i-Pr)), unsubstituted butyl (Bu, e.g., unsubstituted n-butyl (n-Bu), unsubstituted tert-butyl (tert-Bu or t-Bu), unsubstituted sec-butyl (sec-Bu), unsubstituted isobutyl (i-Bu)). In certain embodiments, the alkyl group is a substituted $C_{1-10}$ alkyl (such as substituted $C_{1-6}$ alkyl, e.g., —$CF_3$, Bn).

The term "haloalkyl" is a substituted alkyl group, wherein one or more of the hydrogen atoms are independently replaced by a halogen, e.g., fluoro, bromo, chloro, or iodo. In some embodiments, the haloalkyl moiety has 1 to 8 carbon atoms ("$C_{1-8}$ haloalkyl"). In some embodiments, the haloalkyl moiety has 1 to 6 carbon atoms ("$C_{1-6}$ haloalkyl"). In some embodiments, the haloalkyl moiety has 1 to 4 carbon atoms ("$C_{1-4}$ haloalkyl"). In some embodiments, the haloalkyl moiety has 1 to 3 carbon atoms ("$C_{1-3}$ haloalkyl"). In some embodiments, the haloalkyl moiety has 1 to 2 carbon atoms ("$C_{1-2}$ haloalkyl"). Examples of haloalkyl groups include —$CHF_2$, —$CH_2F$, —$CF_3$, —$CH_2CF_3$, —$CF_2CF_3$, —$CF_2CF_2CF_3$, —$CCl_3$, —$CFCl_2$, —$CF_2Cl$, and the like.

The term "heteroalkyl" refers to an alkyl group, which further includes at least one heteroatom (e.g., 1, 2, 3, or 4 heteroatoms) selected from oxygen, nitrogen, or sulfur within (i.e., inserted between adjacent carbon atoms of) and/or placed at one or more terminal position(s) of the parent chain. In certain embodiments, a heteroalkyl group refers to a saturated group having from 1 to 20 carbon atoms and 1 or more heteroatoms within the parent chain ("hetero$C_{1-20}$ alkyl"). In some embodiments, a heteroalkyl group is a saturated group having 1 to 18 carbon atoms and 1 or more heteroatoms within the parent chain ("hetero$C_{1-8}$ alkyl"). In some embodiments, a heteroalkyl group is a saturated group having 1 to 16 carbon atoms and 1 or more heteroatoms within the parent chain ("hetero$C_{1-16}$ alkyl"). In some embodiments, a heteroalkyl group is a saturated group having 1 to 14 carbon atoms and 1 or more heteroatoms within the parent chain ("hetero$C_{1-14}$ alkyl"). In some embodiments, a heteroalkyl group is a saturated group having 1 to 12 carbon atoms and 1 or more heteroatoms within the parent chain ("hetero$C_{1-12}$ alkyl"). In some embodiments, a heteroalkyl group is a saturated group having 1 to 10 carbon atoms and 1 or more heteroatoms within the parent chain ("hetero$C_{1-10}$ alkyl"). In some embodiments, a heteroalkyl group is a saturated group having 1 to 8 carbon atoms and 1 or more heteroatoms within the parent chain ("hetero$C_{1-8}$ alkyl"). In some embodiments, a heteroalkyl group is a saturated group having 1 to 6 carbon atoms and 1 or more heteroatoms within the parent chain ("hetero$C_{1-6}$ alkyl"). In some embodiments, a heteroalkyl group is a saturated group having 1 to 4 carbon atoms and 1 or 2 heteroatoms within the parent chain ("hetero$C_{1-4}$ alkyl"). In some embodiments, a heteroalkyl group is a saturated group having 1 to 3 carbon atoms and 1 heteroatom within the parent chain ("hetero$C_{1-3}$ alkyl"). In some embodiments, a heteroalkyl group is a saturated group having 1 to 2 carbon atoms and 1 heteroatom within the parent chain ("hetero$C_{1-2}$ alkyl"). In some embodiments, a heteroalkyl group is a saturated group having 1 carbon atom and 1 heteroatom ("hetero$C_1$ alkyl"). In some embodiments, the heteroalkyl group defined herein is a partially unsaturated group having 1 or more heteroatoms within the parent chain and at least one unsaturated carbon, such as a carbonyl group. For example, a heteroalkyl group may comprise an amide or ester functionality in its parent chain such that one or more carbon atoms are unsaturated carbonyl groups. Unless otherwise specified, each instance of a heteroalkyl group is independently unsubstituted (an "unsubstituted heteroalkyl") or substituted (a "substituted heteroalkyl") with one or more substituents. In certain embodiments, the heteroalkyl group is an unsubstituted hetero$C_{1-20}$ alkyl. In certain embodiments, the heteroalkyl group is an unsubstituted hetero$C_{1-10}$ alkyl. In certain embodiments, the heteroalkyl group is a substituted hetero$C_{1-20}$ alkyl. In certain embodiments, the heteroalkyl group is an unsubstituted hetero$C_{1-10}$alkyl.

The term "alkenyl" refers to a radical of a straight-chain or branched hydrocarbon group having from 2 to 10 carbon atoms and one or more carbon-carbon double bonds (e.g., 1, 2, 3, or 4 double bonds). In some embodiments, an alkenyl group has 2 to 9 carbon atoms ("$C_{2-9}$ alkenyl"). In some embodiments, an alkenyl group has 2 to 8 carbon atoms ("$C_{2-8}$ alkenyl"). In some embodiments, an alkenyl group has 2 to 7 carbon atoms ("$C_{2-7}$ alkenyl"). In some embodiments, an alkenyl group has 2 to 6 carbon atoms ("$C_{2-6}$ alkenyl"). In some embodiments, an alkenyl group has 2 to 5 carbon atoms ("$C_{2-5}$ alkenyl"). In some embodiments, an alkenyl group has 2 to 4 carbon atoms ("$C_{2-4}$ alkenyl"). In some embodiments, an alkenyl group has 2 to 3 carbon atoms ("$C_{2-3}$ alkenyl"). In some embodiments, an alkenyl group has 2 carbon atoms ("$C_2$ alkenyl"). The one or more carbon-carbon double bonds can be internal (such as in 2-butenyl) or terminal (such as in 1-butenyl). Examples of $C_{2-4}$ alkenyl groups include ethenyl ($C_2$), 1-propenyl ($C_3$), 2-propenyl ($C_3$), 1-butenyl ($C_4$), 2-butenyl ($C_4$), butadienyl ($C_4$), and the like. Examples of $C_{2-6}$ alkenyl groups include the aforementioned $C_{2-4}$ alkenyl groups as well as pentenyl ($C_5$), pentadienyl ($C_5$), hexenyl ($C_6$), and the like. Additional examples of alkenyl include heptenyl ($C_7$), octenyl ($C_8$), octatrienyl ($C_8$), and the like. Unless otherwise specified, each instance of an alkenyl group is independently unsubstituted (an "unsubstituted alkenyl") or substituted (a "substituted alkenyl") with one or more substituents. In certain embodiments, the alkenyl group is an unsubstituted $C_{2-10}$ alkenyl. In certain embodiments, the alkenyl group is a substituted $C_{2-10}$ alkenyl. In an alkenyl group, a C═C double bond for which the stereochemistry is not specified (e.g., —CH═$CHCH_3$ or

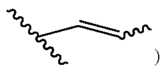
)

may be an (E)- or (Z)-double bond.

The term "heteroalkenyl" refers to an alkenyl group, which further includes at least one heteroatom (e.g., 1, 2, 3, or 4 heteroatoms) selected from oxygen, nitrogen, or sulfur within (i.e., inserted between adjacent carbon atoms of) and/or placed at one or more terminal position(s) of the parent chain. In certain embodiments, a heteroalkenyl group refers to a group having from 2 to 10 carbon atoms, at least one double bond, and 1 or more heteroatoms within the parent chain ("hetero$C_{2-10}$ alkenyl"). In some embodiments, a heteroalkenyl group has 2 to 9 carbon atoms at least one double bond, and 1 or more heteroatoms within the parent chain ("hetero$C_{2-9}$ alkenyl"). In some embodiments, a heteroalkenyl group has 2 to 8 carbon atoms, at least one double bond, and 1 or more heteroatoms within the parent chain ("hetero$C_{2-8}$ alkenyl"). In some embodiments, a heteroalkenyl group has 2 to 7 carbon atoms, at least one double bond, and 1 or more heteroatoms within the parent chain ("hetero$C_{2-7}$ alkenyl"). In some embodiments, a heteroalkenyl group has 2 to 6 carbon atoms, at least one double bond, and 1 or more heteroatoms within the parent chain ("hetero$C_{2-6}$ alkenyl"). In some embodiments, a heteroalkenyl group has 2 to 5 carbon atoms, at least one double bond, and 1 or 2 heteroatoms within the parent chain ("hetero$C_{2-5}$ alkenyl"). In some embodiments, a heteroalkenyl group has 2 to 4 carbon atoms, at least one double bond, and 1 or 2 heteroatoms within the parent chain ("hetero$C_{2-4}$ alkenyl"). In some embodiments, a heteroalkenyl group has 2 to 3 carbon atoms, at least one double bond, and 1 heteroatom within the parent chain ("hetero$C_{2-3}$ alkenyl"). In some embodiments, a heteroalkenyl group has 2 to 6 carbon atoms, at least one double bond, and 1 or 2 heteroatoms within the parent chain ("hetero$C_{2-6}$ alkenyl"). Unless otherwise specified, each instance of a heteroalkenyl group is independently unsubstituted (an "unsubstituted heteroalkenyl") or substituted (a "substituted heteroalkenyl") with one or more substituents. In certain embodiments, the heteroalkenyl group is an unsubstituted hetero$C_{2-10}$ alkenyl. In certain embodiments, the heteroalkenyl group is a substituted hetero$C_{2-10}$ alkenyl.

The term "alkynyl" refers to a radical of a straight-chain or branched hydrocarbon group having from 2 to 10 carbon atoms and one or more carbon-carbon triple bonds (e.g., 1, 2, 3, or 4 triple bonds) ("$C_{2-10}$ alkynyl"). In some embodiments, an alkynyl group has 2 to 9 carbon atoms ("$C_{2-9}$ alkynyl"). In some embodiments, an alkynyl group has 2 to 8 carbon atoms ("$C_{2-8}$ alkynyl"). In some embodiments, an alkynyl group has 2 to 7 carbon atoms ("$C_{2-7}$ alkynyl"). In some embodiments, an alkynyl group has 2 to 6 carbon atoms ("$C_{2-6}$ alkynyl"). In some embodiments, an alkynyl group has 2 to 5 carbon atoms ("$C_{2-5}$ alkynyl"). In some embodiments, an alkynyl group has 2 to 4 carbon atoms ("$C_{2-4}$ alkynyl"). In some embodiments, an alkynyl group has 2 to 3 carbon atoms ("$C_{2-3}$ alkynyl"). In some embodiments, an alkynyl group has 2 carbon atoms ("$C_2$ alkynyl"). The one or more carbon-carbon triple bonds can be internal (such as in 2-butynyl) or terminal (such as in 1-butynyl). Examples of $C_{2-4}$ alkynyl groups include, without limitation, ethynyl ($C_2$), 1-propynyl ($C_3$), 2-propynyl ($C_3$), 1-butynyl ($C_4$), 2-butynyl ($C_4$), and the like. Examples of $C_{2-6}$ alkenyl groups include the aforementioned $C_{2-4}$ alkynyl groups as well as pentynyl ($C_5$), hexynyl ($C_6$), and the like. Additional examples of alkynyl include heptynyl ($C_7$), octynyl ($C_8$), and the like. Unless otherwise specified, each instance of an alkynyl group is independently unsubstituted (an "unsubstituted alkynyl") or substituted (a "substituted alkynyl") with one or more substituents. In certain embodiments, the alkynyl group is an unsubstituted $C_{2-10}$ alkynyl. In certain embodiments, the alkynyl group is a substituted $C_{2-10}$ alkynyl.

The term "heteroalkynyl" refers to an alkynyl group, which further includes at least one heteroatom (e.g., 1, 2, 3, or 4 heteroatoms) selected from oxygen, nitrogen, or sulfur within (i.e., inserted between adjacent carbon atoms of) and/or placed at one or more terminal position(s) of the parent chain. In certain embodiments, a heteroalkynyl group refers to a group having from 2 to 10 carbon atoms, at least one triple bond, and 1 or more heteroatoms within the parent chain ("hetero$C_{2-10}$ alkynyl"). In some embodiments, a heteroalkynyl group has 2 to 9 carbon atoms, at least one triple bond, and 1 or more heteroatoms within the parent chain ("hetero$C_{2-9}$ alkynyl"). In some embodiments, a heteroalkynyl group has 2 to 8 carbon atoms, at least one triple bond, and 1 or more heteroatoms within the parent chain ("hetero$C_{2-8}$ alkynyl"). In some embodiments, a heteroalkynyl group has 2 to 7 carbon atoms, at least one triple bond, and 1 or more heteroatoms within the parent chain ("hetero$C_{2-7}$ alkynyl"). In some embodiments, a heteroalkynyl group has 2 to 6 carbon atoms, at least one triple bond, and 1 or more heteroatoms within the parent chain ("hetero$C_{2-6}$ alkynyl"). In some embodiments, a heteroalkynyl group has 2 to 5 carbon atoms, at least one triple bond, and 1 or 2 heteroatoms within the parent chain ("hetero$C_{2-5}$ alkynyl"). In some embodiments, a heteroalkynyl group has 2 to 4 carbon atoms, at least one triple bond, and lor 2 heteroatoms within the parent chain ("hetero$C_{2-4}$ alkynyl"). In some embodiments, a heteroalkynyl group has 2 to 3 carbon atoms, at least one triple bond, and 1 heteroatom within the parent chain ("hetero$C_{2-3}$ alkynyl"). In some embodiments, a heteroalkynyl group has 2 to 6 carbon atoms, at least one triple bond, and 1 or 2 heteroatoms within the parent chain ("hetero$C_{2-6}$ alkynyl"). Unless otherwise specified, each instance of a heteroalkynyl group is independently unsubstituted (an "unsubstituted heteroalkynyl") or substituted (a "substituted heteroalkynyl") with one or more substituents. In certain embodiments, the heteroalkynyl group is an unsubstituted hetero$C_{2-10}$ alkynyl. In certain embodiments, the heteroalkynyl group is a substituted hetero$C_{2-10}$ alkynyl.

The term "carbocyclyl" or "carbocyclic" refers to a radical of a non-aromatic cyclic hydrocarbon group having from 3 to 14 ring carbon atoms ("$C_{3-14}$ carbocyclyl") and zero heteroatoms in the non-aromatic ring system. In some embodiments, a carbocyclyl group has 3 to 10 ring carbon atoms ("$C_{3-10}$ carbocyclyl"). In some embodiments, a carbocyclyl group has 3 to 8 ring carbon atoms ("$C_{3-8}$ carbocyclyl"). In some embodiments, a carbocyclyl group has 3 to 7 ring carbon atoms ("$C_{3-7}$ carbocyclyl"). In some embodiments, a carbocyclyl group has 3 to 6 ring carbon atoms ("$C_{3-6}$ carbocyclyl"). In some embodiments, a carbocyclyl group has 4 to 6 ring carbon atoms ("$C_{4-6}$ carbocyclyl"). In some embodiments, a carbocyclyl group has 5 to 6 ring carbon atoms ("$C_{5-6}$ carbocyclyl"). In some embodiments, a carbocyclyl group has 5 to 10 ring carbon atoms ("$C_{5-10}$ carbocyclyl"). Exemplary $C_{3-6}$ carbocyclyl groups include, without limitation, cyclopropyl ($C_3$), cyclopropenyl ($C_3$), cyclobutyl ($C_4$), cyclobutenyl ($C_4$), cyclopentyl ($C_5$), cyclopentenyl ($C_5$), cyclohexyl ($C_6$), cyclohexenyl ($C_6$), cyclohexadienyl ($C_6$), and the like. Exemplary $C_{3-8}$ carbocyclyl groups include, without limitation, the aforementioned $C_{3-6}$ carbocyclyl groups as well as cycloheptyl ($C_7$), cycloheptenyl ($C_7$), cycloheptadienyl ($C_7$), cycloheptatrienyl ($C_7$), cyclooctyl ($C_8$), cyclooctenyl ($C_8$), bicyclo[2.2.1]heptanyl ($C_7$), bicyclo[2.2.2]octanyl (C), and the like. Exemplary $C_{3-10}$ carbocyclyl groups include, without limitation, the aforementioned $C_{3-8}$ carbocyclyl groups as well as cyclononyl ($C_9$), cyclononenyl ($C_9$), cyclodecyl ($C_{10}$), cyclodecenyl ($C_{10}$), octahydro-1H-indenyl ($C_9$), decahydronaphthalenyl ($C_{10}$), spiro[4.5]decanyl ($C_{10}$), and the like. As the foregoing examples illustrate, in certain embodiments, the carbocyclyl group is either monocyclic ("monocyclic carbocyclyl") or polycyclic (e.g., containing a fused, bridged or spiro ring system such as a bicyclic system ("bicyclic carbocyclyl") or tricyclic system ("tricyclic carbocyclyl")) and can be saturated or can contain one or more carbon-carbon double or triple bonds. "Carbocyclyl" also includes ring systems wherein the carbocyclyl ring, as defined above, is fused with one or more aryl or heteroaryl groups wherein the point of attachment is on the carbocyclyl ring, and in such instances, the number of carbons continue to designate the number of carbons in the carbocyclic ring system. Unless otherwise specified, each instance of a carbocyclyl group is independently unsubstituted (an "unsubstituted carbocyclyl") or substituted (a "substituted carbocyclyl") with one or more substituents. In certain embodiments, the carbocyclyl group is an unsubstituted $C_{3-14}$ carbocyclyl. In certain embodiments, the carbocyclyl group is a substituted $C_{3-14}$ carbocyclyl.

In some embodiments, "carbocyclyl" is a monocyclic, saturated carbocyclyl group having from 3 to 14 ring carbon atoms ("$C_{3-14}$ cycloalkyl"). In some embodiments, a cycloalkyl group has 3 to 10 ring carbon atoms ("$C_{3-10}$ cycloalkyl"). In some embodiments, a cycloalkyl group has 3 to 8 ring carbon atoms ("$C_{3-8}$ cycloalkyl"). In some embodiments, a cycloalkyl group has 3 to 6 ring carbon atoms ("$C_{3-6}$ cycloalkyl"). In some embodiments, a cycloalkyl group has 4 to 6 ring carbon atoms ("$C_{4-6}$ cycloalkyl"). In some embodiments, a cycloalkyl group has 5 to 6 ring carbon atoms ("$C_{5-6}$ cycloalkyl"). In some embodiments, a cycloalkyl group has 5 to 10 ring carbon atoms ("$C_{5-10}$ cycloalkyl"). Examples of $C_{5-6}$ cycloalkyl groups include cyclopentyl ($C_5$) and cyclohexyl ($C_5$). Examples of $C_{3-6}$ cycloalkyl groups include the aforementioned $C_{5-6}$ cycloalkyl groups as well as cyclopropyl ($C_3$) and cyclobutyl ($C_4$). Examples of $C_{3-8}$ cycloalkyl groups include the aforementioned $C_{3-6}$ cycloalkyl groups as well as cycloheptyl ($C_7$) and cyclooctyl ($C_8$). Unless otherwise specified, each instance of a cycloalkyl group is independently unsubstituted (an "unsubstituted cycloalkyl") or substituted (a "substituted cycloalkyl") with one or more substituents. In certain embodiments, the cycloalkyl group is an unsubstituted $C_{3-14}$ cycloalkyl. In certain embodiments, the cycloalkyl group is a substituted $C_{3-14}$ cycloalkyl.

The term "heterocyclyl" or "heterocyclic" refers to a radical of a 3- to 14-membered non-aromatic ring system having ring carbon atoms and 1 to 4 ring heteroatoms, wherein each heteroatom is independently selected from nitrogen, oxygen, and sulfur ("3-14 membered heterocyclyl"). In heterocyclyl groups that contain one or more nitrogen atoms, the point of attachment can be a carbon or nitrogen atom, as valency permits. A heterocyclyl group can either be monocyclic ("monocyclic heterocyclyl") or polycyclic (e.g., a fused, bridged or spiro ring system such as a bicyclic system ("bicyclic heterocyclyl") or tricyclic system ("tricyclic heterocyclyl")), and can be saturated or can contain one or more carbon-carbon double or triple bonds. Heterocyclyl polycyclic ring systems can include one or more heteroatoms in one or both rings. "Heterocyclyl" also includes ring systems wherein the heterocyclyl ring, as defined above, is fused with one or more carbocyclyl groups wherein the point of attachment is either on the carbocyclyl or heterocyclyl ring, or ring systems wherein the heterocyclyl ring, as defined above, is fused with one or more aryl or heteroaryl groups, wherein the point of attachment is on the heterocyclyl ring, and in such instances, the number of ring members continue to designate the number of ring members in the heterocyclyl ring system. Unless otherwise specified, each instance of heterocyclyl is independently unsubstituted (an "unsubstituted heterocyclyl") or substituted (a "substituted heterocyclyl") with one or more substituents. In certain embodiments, the heterocyclyl group is an unsubstituted 3-14 membered heterocyclyl. In certain embodiments, the heterocyclyl group is a substituted 3-14 membered heterocyclyl.

In some embodiments, a heterocyclyl group is a 5-10 membered non-aromatic ring system having ring carbon atoms and 1-4 ring heteroatoms, wherein each heteroatom is independently selected from nitrogen, oxygen, and sulfur ("5-10 membered heterocyclyl"). In some embodiments, a heterocyclyl group is a 5-8 membered non-aromatic ring system having ring carbon atoms and 1-4 ring heteroatoms, wherein each heteroatom is independently selected from nitrogen, oxygen, and sulfur ("5-8 membered heterocyclyl"). In some embodiments, a heterocyclyl group is a 5-6 membered non-aromatic ring system having ring carbon atoms and 1-4 ring heteroatoms, wherein each heteroatom is independently selected from nitrogen, oxygen, and sulfur ("5-6 membered heterocyclyl"). In some embodiments, the 5-6 membered heterocyclyl has 1-3 ring heteroatoms selected from nitrogen, oxygen, and sulfur. In some embodiments, the 5-6 membered heterocyclyl has 1-2 ring heteroatoms selected from nitrogen, oxygen, and sulfur. In some embodiments, the 5-6 membered heterocyclyl has 1 ring heteroatom selected from nitrogen, oxygen, and sulfur.

Exemplary 3-membered heterocyclyl groups containing 1 heteroatom include, without limitation, azirdinyl, oxiranyl, and thiiranyl. Exemplary 4-membered heterocyclyl groups containing 1 heteroatom include, without limitation, azetidinyl, oxetanyl, and thietanyl. Exemplary 5-membered heterocyclyl groups containing 1 heteroatom include, without limitation, tetrahydrofuranyl, dihydrofuranyl, tetrahydrothiophenyl, dihydrothiophenyl, pyrrolidinyl, dihydropyrrolyl, and pyrrolyl-2,5-dione. Exemplary 5-membered heterocyclyl groups containing 2 heteroatoms include, without limitation, dioxolanyl, oxathiolanyl and dithiolanyl. Exemplary 5-membered heterocyclyl groups containing 3 heteroatoms include, without limitation, triazolinyl, oxadiazolinyl, and thiadiazolinyl. Exemplary 6-membered heterocyclyl groups containing 1 heteroatom include, without limitation, piperidinyl, tetrahydropyranyl, dihydropyridinyl, and thianyl. Exemplary 6-membered heterocyclyl groups containing 2 heteroatoms include, without limitation, piperazinyl, morpholinyl, dithianyl, and dioxanyl. Exemplary 6-membered heterocyclyl groups containing 3 heteroatoms include, without limitation, triazinyl. Exemplary 7-membered heterocyclyl groups containing 1 heteroatom include, without limitation, azepanyl, oxepanyl and thiepanyl. Exemplary 8-membered heterocyclyl groups containing 1 heteroatom include, without limitation, azocanyl, oxecanyl and thiocanyl. Exemplary bicyclic heterocyclyl groups include, without limitation, indolinyl, isoindolinyl, dihydrobenzofuranyl, dihydrobenzothienyl, tetrahydrobenzothienyl, tetrahydrobenzofuranyl, tetrahydroindolyl, tetrahydroquinolinyl, tetrahydroisoquinolinyl, decahydroquinolinyl, decahydroisoquinolinyl, octahydrochromenyl, octahydroisochromenyl, decahydronaphthyridinyl, decahydro-1,8-naphthyridinyl, octahydropyrrolo[3,2-b]pyrrole, indolinyl, phthalimidyl, naphthalimidyl, chromanyl, chromenyl, 1H-benzo[e][1,4]diazepinyl, 1,4,5,7-tetrahydropyrano[3,4-b]pyrrolyl, 5,6-dihydro-4H-furo[3,2-b]pyrrolyl, 6,7-dihydro-5H-furo[3,2-b]pyranyl, 5,7-dihydro-4H-thieno[2,3-c]pyranyl, 2,3-dihydro-1H-pyrrolo[2,3-b]pyridinyl, 2,3-dihydrofuro[2,3-b]pyridinyl, 4,5,6,7-tetrahydro-1H-pyrrolo[2,3-b]pyridinyl, 4,5,6,7-tetrahydrofuro[3,2-c]pyridinyl, 4,5,6,7-tetrahydrothieno[3,2-b]pyridinyl, 1,2,3,4-tetrahydro-1,6-naphthyridinyl, and the like.

The term "aryl" refers to a radical of a monocyclic or polycyclic (e.g., bicyclic or tricyclic) 4n+2 aromatic ring system (e.g., having 6, 10, or 14 ?t electrons shared in a cyclic array) having 6-14 ring carbon atoms and zero heteroatoms provided in the aromatic ring system ("$C_{6-14}$ aryl"). In some embodiments, an aryl group has 6 ring carbon atoms ("$C_6$ aryl"; e.g., phenyl). In some embodiments, an aryl group has 10 ring carbon atoms ("$C_{10}$ aryl"; e.g., naphthyl such as 1-naphthyl and 2-naphthyl). In some embodiments, an aryl group has 14 ring carbon atoms ("$C_{14}$ aryl"; e.g., anthracyl). "Aryl" also includes ring systems wherein the aryl ring, as defined above, is fused with one or more carbocyclyl or heterocyclyl groups wherein the radical or point of attachment is on the aryl ring, and in such instances, the number of carbon atoms continue to designate the number of carbon atoms in the aryl ring system. Unless otherwise specified, each instance of an aryl group is independently unsubstituted (an "unsubstituted aryl") or substituted (a "substituted aryl") with one or more substituents. In certain embodiments, the aryl group is an unsubstituted $C_{6-14}$ aryl. In certain embodiments, the aryl group is a substituted $C_{6-14}$ aryl.

"Aralkyl" is a subset of "alkyl" and refers to an alkyl group substituted by an aryl group, wherein the point of attachment is on the alkyl moiety.

The term "heteroaryl" refers to a radical of a 5-14 membered monocyclic or polycyclic (e.g., bicyclic, tricyclic) 4n+2 aromatic ring system (e.g., having 6, 10, or 14 $\pi$ electrons shared in a cyclic array) having ring carbon atoms and 1-4 ring heteroatoms provided in the aromatic ring system, wherein each heteroatom is independently selected from nitrogen, oxygen, and sulfur ("5-14 membered heteroaryl"). In heteroaryl groups that contain one or more nitrogen atoms, the point of attachment can be a carbon or nitrogen atom, as valency permits. Heteroaryl polycyclic ring systems can include one or more heteroatoms in one or both rings. "Heteroaryl" includes ring systems wherein the heteroaryl ring, as defined above, is fused with one or more carbocyclyl or heterocyclyl groups wherein the point of attachment is on the heteroaryl ring, and in such instances, the number of ring members continue to designate the number of ring members in the heteroaryl ring system. "Heteroaryl" also includes ring systems wherein the heteroaryl ring, as defined above, is fused with one or more aryl groups wherein the point of attachment is either on the aryl or heteroaryl ring, and in such instances, the number of ring members designates the number of ring members in the fused polycyclic (aryl/heteroaryl) ring system. Polycyclic heteroaryl groups wherein one ring does not contain a heteroatom (e.g., indolyl, quinolinyl, carbazolyl, and the like) the point of attachment can be on either ring, i.e., either the ring bearing a heteroatom (e.g., 2-indolyl) or the ring that does not contain a heteroatom (e.g., 5-indolyl).

In some embodiments, a heteroaryl group is a 5-10 membered aromatic ring system having ring carbon atoms and 1-4 ring heteroatoms provided in the aromatic ring system, wherein each heteroatom is independently selected from nitrogen, oxygen, and sulfur ("5-10 membered heteroaryl"). In some embodiments, a heteroaryl group is a 5-8 membered aromatic ring system having ring carbon atoms and 1-4 ring heteroatoms provided in the aromatic ring system, wherein each heteroatom is independently selected from nitrogen, oxygen, and sulfur ("5-8 membered heteroaryl"). In some embodiments, a heteroaryl group is a 5-6 membered aromatic ring system having ring carbon atoms and 1-4 ring heteroatoms provided in the aromatic ring system, wherein each heteroatom is independently selected from nitrogen, oxygen, and sulfur ("5-6 membered heteroaryl"). In some embodiments, the 5-6 membered heteroaryl has 1-3 ring heteroatoms selected from nitrogen, oxygen, and sulfur. In some embodiments, the 5-6 membered heteroaryl has 1-2 ring heteroatoms selected from nitrogen, oxygen, and sulfur. In some embodiments, the 5-6 membered heteroaryl has 1 ring heteroatom selected from nitrogen, oxygen, and sulfur. Unless otherwise specified, each instance of a heteroaryl group is independently unsubstituted (an "unsubstituted heteroaryl") or substituted (a "substituted heteroaryl") with one or more substituents. In certain embodiments, the heteroaryl group is an unsubstituted 5-14 membered heteroaryl. In certain embodiments, the heteroaryl group is a substituted 5-14 membered heteroaryl.

Exemplary 5-membered heteroaryl groups containing 1 heteroatom include, without limitation, pyrrolyl, furanyl, and thiophenyl. Exemplary 5-membered heteroaryl groups containing 2 heteroatoms include, without limitation, imidazolyl, pyrazolyl, oxazolyl, isoxazolyl, thiazolyl, and isothiazolyl. Exemplary 5-membered heteroaryl groups containing 3 heteroatoms include, without limitation, triazolyl, oxadiazolyl, and thiadiazolyl. Exemplary 5-membered heteroaryl groups containing 4 heteroatoms include, without limitation, tetrazolyl. Exemplary 6-membered heteroaryl groups containing 1 heteroatom include, without limitation, pyridinyl. Exemplary 6-membered heteroaryl groups containing 2 heteroatoms include, without limitation, pyridazinyl, pyrimidinyl, and pyrazinyl. Exemplary 6-membered heteroaryl groups containing 3 or 4 heteroatoms include, without limitation, triazinyl and tetrazinyl, respectively. Exemplary 7-membered heteroaryl groups containing 1 heteroatom include, without limitation, azepinyl, oxepinyl, and thiepinyl. Exemplary 5,6-bicyclic heteroaryl groups include, without limitation, indolyl, isoindolyl, indazolyl, benzotriazolyl, benzothiophenyl, isobenzothiophenyl, benzofuranyl, benzoisofuranyl, benzimidazolyl, benzoxazolyl, benzisoxazolyl, benzoxadiazolyl, benzthiazolyl, benzisothiazolyl, benzthiadiazolyl, indolizinyl, and purinyl. Exemplary 6,6-bicyclic heteroaryl groups include, without limitation, naphthyridinyl, pteridinyl, quinolinyl, isoquinolinyl, cinnolinyl, quinoxalinyl, phthalazinyl, and quinazolinyl. Exemplary tricyclic heteroaryl groups include, without limitation, phenanthridinyl, dibenzofuranyl, carbazolyl, acridinyl, phenothiazinyl, phenoxazinyl, and phenazinyl.

"Heteroaralkyl" is a subset of "alkyl" and refers to an alkyl group substituted by a heteroaryl group, wherein the point of attachment is on the alkyl moiety.

The term "unsaturated" or "partially unsaturated" refers to a moiety that includes at least one double or triple bond.

The term "saturated" refers to a moiety that does not contain a double or triple bond, i.e., the moiety only contains single bonds.

Affixing the suffix "-ene" to a group indicates the group is a divalent moiety, e.g., alkylene is the divalent moiety of alkyl, alkenylene is the divalent moiety of alkenyl, alkynylene is the divalent moiety of alkynyl, heteroalkylene is the divalent moiety of heteroalkyl, heteroalkenylene is the divalent moiety of heteroalkenyl, heteroalkynylene is the divalent moiety of heteroalkynyl, carbocyclylene is the divalent moiety of carbocyclyl, heterocyclylene is the divalent moiety of heterocyclyl, arylene is the divalent moiety of aryl, and heteroarylene is the divalent moiety of heteroaryl.

A group is optionally substituted unless expressly provided otherwise. The term "optionally substituted" refers to being substituted or unsubstituted. In certain embodiments, alkyl, alkenyl, alkynyl, heteroalkyl, heteroalkenyl, heteroalkynyl, carbocyclyl, heterocyclyl, aryl, and heteroaryl groups are optionally substituted. "Optionally substituted" refers to a group which may be substituted or unsubstituted (e.g., "substituted" or "unsubstituted" alkyl, "substituted" or "unsubstituted" alkenyl, "substituted" or "unsubstituted" alkynyl, "substituted" or "unsubstituted" heteroalkyl, "substituted" or "unsubstituted" heteroalkenyl, "substituted" or "unsubstituted" heteroalkynyl, "substituted" or "unsubstituted" carbocyclyl, "substituted" or "unsubstituted" heterocyclyl, "substituted" or "unsubstituted" aryl or "substituted" or "unsubstituted" heteroaryl group). In general, the term "substituted" means that at least one hydrogen present on a group is replaced with a permissible substituent, e.g., a substituent which upon substitution results in a stable compound, e.g., a compound which does not spontaneously undergo transformation such as by rearrangement, cyclization, elimination, or other reaction. Unless otherwise indicated, a "substituted" group has a substituent at one or more substitutable positions of the group, and when more than one position in any given structure is substituted, the substituent is either the same or different at each position. The term "substituted" is contemplated to include substitution with all permissible substituents of organic compounds, and includes any of the substituents described herein that results in the formation of a stable compound. The present disclosure contemplates any and all such combinations in order to arrive at a stable compound. For purposes of this disclosure, heteroatoms such as nitrogen may have hydrogen substituents and/or any suitable substituent as described herein which satisfy the valencies of the heteroatoms and results in the formation of a stable moiety. The disclosure is not intended to be limited in any manner by the exemplary substituents described herein.

Exemplary carbon atom substituents include, but are not limited to, halogen, —CN, —$NO_2$, —$N_3$, —$SO_2H$, —$SO_3H$, —OH, —OR$^{aa}$, —ON(R$^{bb}$)$_2$, —N(R$^{bb}$)$_2$, —N(R$^{bb}$)$_3$$^+$X$^-$, —N(OR$^{cc}$)R$^{bb}$, —SH, —SR$^{aa}$, —SSR$^{cc}$, —C(═O)R$^{aa}$, —$CO_2H$, —CHO, —C(OR$^{cc}$)$_3$, —$CO_2$R$^{aa}$, —OC(═O)R$^{aa}$, —$OCO_2$R$^{aa}$, —C(═O)N(R$^{bb}$)$_2$, —OC(═O)N(R$^{bb}$)$_2$, —NR$^{bb}$C(═O)R$^{aa}$, —NR$^{bb}$$CO_2$R$^{aa}$, —NR$^{bb}$C(═O)N(R$^{bb}$)$_2$, —C(═NR$^{bb}$)R$^{aa}$, —C(═NR$^{bb}$)OR$^{aa}$, —OC(═NR$^{bb}$)R$^{aa}$, —OC(═NR$^{bb}$)OR$^{aa}$, —C(═NR$^{bb}$)N(R$^{bb}$)$_2$, —OC(═NR$^{bb}$)N(R$^{bb}$)$_2$, —NR$^{bb}$C(═NR$^{bb}$)N(R$^{bb}$)$_2$, —C(═O)NR$^{bb}$$SO_2$R$^{aa}$, —NR$^{bb}$$SO_2$R$^{aa}$, —$SO_2$N(R$^{bb}$)$_2$, —$SO_2$R$^{aa}$, —$SO_2$OR$^{aa}$, —$OSO_2$R$^{aa}$, —S(═O)R$^{aa}$, —OS(═O)R$^{aa}$, —Si(R$^{aa}$)$_3$, —OSi(R$^{aa}$)$_3$—C(═S)N(R$^{bb}$)$_2$, —C(═O)SR$^{aa}$, —C(═S)SR$^{aa}$, —SC(═S)SR$^{aa}$, —SC(═O)SR$^{aa}$, —OC(═O)SR$^{aa}$, —SC(═O)OR$^{aa}$, —SC(═O)R$^{aa}$, —P(═O)(R$^{aa}$)$_2$, —P(═O)(OR$^{cc}$)$_2$, —OP(═O)(R$^{aa}$)$_2$, —OP(═O)(OR$^{cc}$)$_2$, —P(═O)(N(R$^{bb}$)$_2$)$_2$, —OP(═O)(N(R$^{bb}$)$_2$)$_2$, —NR$^{bb}$P(═O)(R$^{aa}$)$_2$, —NR$^{bb}$P(═O)(OR$^{cc}$)$_2$, —NR$^{bb}$P(═O)(N(R$^{bb}$)$_2$)$_2$, —P(R$^{cc}$)$_2$, —P(OR$^{cc}$)$_2$, —P(R$^{cc}$)$_3$$^+$X$^-$, —P(OR$^{cc}$)$_3$$^+$X$^-$, —P(R$^{cc}$)$_4$, —P(OR$^{cc}$)$_4$, —OP(R$^{cc}$)$_2$, —OP(R$^{cc}$)$_3$$^+$X$^-$, —OP(OR$^{cc}$)$_2$, —OP(OR$^{cc}$)$_3$$^+$X$^-$, —OP(R$^{cc}$)$_4$, —OP(OR$^{cc}$)$_4$, —B(R$^{aa}$)$_2$, —B(OR$^{cc}$)$_2$, —BR$^{aa}$(OR$^{cc}$), $C_{1-10}$ alkyl, $C_{1-10}$ perhaloalkyl, $C_{2-10}$ alkenyl, $C_{2-10}$ alkynyl, hetero$C_{1-10}$ alkyl, hetero$C_{2-10}$ alkenyl, hetero$C_{2-10}$alkynyl, $C_{3-10}$ carbocyclyl, 3-14 membered heterocyclyl, $C_{6-14}$ aryl, and 5-14 membered heteroaryl, wherein each alkyl, alkenyl, alkynyl, heteroalkyl, heteroalkenyl, heteroalkynyl, carbocyclyl, heterocyclyl, aryl, and heteroaryl is independently substituted with 0, 1, 2, 3, 4, or 5 R$^{dd}$ groups; wherein X$^-$ is a counterion; or two geminal hydrogens on a carbon atom are replaced with the group ═O, ═S, ═NN(R$^{bb}$)$_2$, ═NNR$^{bb}$C(═O)R$^{aa}$, ═NNR$^{bb}$C(═O)OR$^{aa}$, ═NNR$^{bb}$S(═O)$_2$R$^{aa}$, ═NR$^{bb}$, or ═NOR$^{cc}$;

each instance of R$^{aa}$ is, independently, selected from $C_{1-10}$ alkyl, $C_{1-10}$ perhaloalkyl, $C_{2-10}$ alkenyl, $C_{2-10}$ alkynyl, hetero$C_{1-10}$alkyl, hetero$C_{2-10}$ alkenyl, hetero$C_{2-10}$ alkynyl, $C_{3-10}$ carbocyclyl, 3-14 membered heterocyclyl, $C_{6-14}$ aryl, and 5-14 membered heteroaryl, or two R$^{aa}$ groups are joined to form a 3-14 membered-heterocyclyl or 5-14 membered heteroaryl ring, wherein each alkyl, alkenyl, alkynyl, heteroalkyl, heteroalkenyl, heteroalkynyl, carbocyclyl, heterocyclyl, aryl, and heteroaryl is independently substituted with 0, 1, 2, 3, 4, or 5 R$^{dd}$ groups;

each instance of R$^{bb}$ is, independently, selected from hydrogen, —OH, —OR$^{aa}$, —N(R$^{cc}$)$_2$, —CN, —C(═O)R$^{aa}$, —C(═O)N(R$^{cc}$)$_2$, —$CO_2$R$^{aa}$, —$SO_2$R$^{aa}$, —C(═NR$^{cc}$)OR$^{aa}$, —C(═NR$^{cc}$)N(R$^{cc}$)$_2$, —$SO_2$N(R$^{cc}$)$_2$, —$SO_2$R$^{cc}$, —$SO_2$OR$^{cc}$, —SOR$^{aa}$, —C(═S)N(R$^{cc}$)$_2$, —C(═O)SR$^{cc}$, —C(═S)SR$^{cc}$, —P(═O)(R$^{aa}$)$_2$, —P(═O)(OR$^{cc}$)$_2$, —P(═O)(N(R$^{cc}$)$_2$)$_2$, $C_{1-10}$ alkyl, $C_{1-10}$ perhaloalkyl, $C_{2-10}$ alkenyl, $C_{2-10}$ alkynyl, hetero$C_{1-10}$ alkyl, hetero$C_{2-10}$ alkenyl, hetero$C_{2-10}$ alkynyl, $C_{3-10}$ carbocyclyl, 3-14 membered heterocyclyl, $C_{6-14}$ aryl, and 5-14 membered heteroaryl, or two R$^{bb}$ groups are joined to form a 3-14 membered heterocyclyl or 5-14 membered heteroaryl ring, wherein each alkyl, alkenyl, alkynyl, heteroalkyl, heteroalkenyl, heteroalkynyl, carbocyclyl, heterocyclyl, aryl, and heteroaryl is independently substituted with 0, 1, 2, 3, 4, or 5 R$^{dd}$ groups; wherein X$^-$ is a counterion;

each instance of R$^{cc}$ is, independently, selected from hydrogen, $C_{1-10}$ alkyl, $C_{1-10}$ perhaloalkyl, $C_{2-10}$ alkenyl, $C_{2-10}$ alkynyl, hetero$C_{1-10}$ alkyl, hetero$C_{2-10}$ alkenyl, hetero$C_{2-10}$ alkynyl, $C_{3-10}$ carbocyclyl, 3-14 membered heterocyclyl, $C_{6-14}$ aryl, and 5-14 membered heteroaryl, or two R$^{cc}$ groups are joined to form a 3-14 membered heterocyclyl or 5-14 membered heteroaryl ring, wherein each alkyl, alkenyl, alkynyl, heteroalkyl, heteroalkenyl, heteroalkynyl, carbocyclyl, heterocyclyl, aryl, and heteroaryl is independently substituted with 0, 1, 2, 3, 4, or 5 R$^{dd}$ groups;

each instance of R$^{dd}$ is, independently, selected from halogen, —CN, —$NO_2$, —$N_3$, —$SO_2H$, —$SO_3H$, —OH, —OR$^{cc}$, —ON(R$^{ff}$)$_2$, —N(R$^{ff}$)$_2$, —N(R$^{ff}$)$_3$$^+$X$^-$, —N(OR$^{ee}$)R$^{ff}$, —SH, —SR$^{ee}$, —SSR$^{ee}$, —C(═O)R$^{ee}$, —$CO_2H$, —$CO_2$R$^{ee}$, —OC(═O)R$^{ee}$, —$OCO_2$R$^{ee}$, —C(═O)N(R$^{ff}$)$_2$, —OC(═O)N(R$^{ff}$)$_2$, —NR$^{ff}$C(═O)R$^{ee}$, —NR$^{ff}$$CO_2$R$^{ee}$, —NR$^{ff}$C(═O)N(R$^{ff}$)$_2$, —C(═NR$^{ff}$)OR$^{ee}$, —OC(═NR$^{ff}$)R$^{ee}$, —OC(═NR$^{ff}$)OR$^{ee}$, —C(═NR$^{ff}$)N(R$^{ff}$)$_2$, —OC(═NR$^{ff}$)N(R$^{ff}$)$_2$, —NR$^{ff}$C(═NR$^{ff}$)N(R$^{ff}$)$_2$, —NR$^{ff}$$SO_2$R$^{ee}$, —$SO_2$N(R$^{ff}$)$_2$, —$SO_2$R$^{ee}$, —$SO_2$OR$^{ee}$, —$OSO_2$R$^{ee}$, —S(═O)R$^{ee}$, —Si(R$^{ee}$)$_3$, —OSi(R$^{ee}$)$_3$, —C(═S)N(R$^{ff}$)$_2$, —C(═O)SR$^{ee}$, —C(═S)SR$^{ee}$, —SC(═S)SR$^{ee}$, —P(═O)(OR$^{ee}$)$_2$, —P(═O)(R$^{ee}$)$_2$, —OP(═O)(R$^{ee}$)$_2$, —OP(═O)(OR$^{ee}$)$_2$, $C_{1-6}$ alkyl, $C_{1-6}$ perhaloalkyl, $C_{2-6}$ alkenyl, $C_{2-6}$ alkynyl, hetero$C_{1-6}$ alkyl, hetero$C_{2-6}$ alkenyl, hetero$C_{2-6}$ alkynyl, $C_{3-10}$ carbocyclyl, 3-10 membered heterocyclyl, $C_{6-10}$ aryl, 5-10 membered heteroaryl, wherein each alkyl, alkenyl, alkynyl, heteroalkyl, heteroalkenyl, heteroalkynyl, carbocyclyl, heterocyclyl, aryl, and heteroaryl is independently substituted with 0, 1, 2, 3, 4, or 5 R$^{gg}$ groups, or two geminal R$^{dd}$ substituents can be joined to form ═O or ═S; wherein X$^-$ is a counterion;

each instance of R$^{ee}$ is, independently, selected from $C_{1-6}$ alkyl, $C_{1-6}$ perhaloalkyl, $C_{2-6}$ alkenyl, $C_{2-6}$ alkynyl, hetero$C_{1-6}$ alkyl, hetero$C_{2-6}$ alkenyl, hetero$C_{2-6}$ alkynyl, $C_{3-10}$ carbocyclyl, $C_{6-10}$ aryl, 3-10 membered heterocyclyl, and 3-10 membered heteroaryl, wherein each alkyl, alkenyl, alkynyl, heteroalkyl, heteroalkenyl, heteroalkynyl, carbocyclyl, heterocyclyl, aryl, and heteroaryl is independently substituted with 0, 1, 2, 3, 4, or 5 R$^{gg}$ groups;

each instance of R$^{ff}$ is, independently, selected from hydrogen, $C_{1-6}$ alkyl, $C_{1-6}$ perhaloalkyl, $C_{2-6}$ alkenyl, $C_{2-6}$ alkynyl, hetero$C_{1-6}$ alkyl, hetero$C_{2-6}$ alkenyl, hetero$C_{2-6}$ alkynyl, $C_{3-10}$ carbocyclyl, 3-10 membered heterocyclyl, $C_{6-10}$ aryl and 5-10 membered heteroaryl, or two R$^{ff}$ groups are joined to form a 3-10 membered heterocyclyl or 5-10 membered heteroaryl, ring, wherein each alkyl, alkenyl, alkynyl, heteroalkyl, heteroalkenyl, heteroalkynyl, carbocyclyl, heterocyclyl, aryl, and heteroaryl is independently substituted with 0, 1, 2, 3, 4, or 5 R$^{gg}$ groups; and each instance of R$^{gg}$ is, independently, halogen, —CN, —$NO_2$, —$N_3$, —$SO_2H$, —$SO_3H$, —OH, —O$C_{1-6}$ alkyl, —ON($C_{1-6}$ alkyl)$_2$, —N($C_{1-6}$ alkyl)$_2$, —N($C_{1-6}$ alkyl)$_3$$^+$X$^-$, —NH($C_{1-6}$ alkyl)$_2$$^+$X$^-$, —$NH_2$($C_{1-6}$ alkyl)$_3$$^+$X$^-$, —$NH_3$$^+$X$^-$, —N(O$C_{1-6}$ alkyl)($C_{1-6}$ alkyl), —N(OH)($C_{1-6}$ alkyl), —NH(OH), —SH, —S$C_{1-6}$ alkyl, —SS($C_{1-6}$ alkyl), —C(═O)($C_{1-6}$ alkyl), —$CO_2H$, —$CO_2$($C_{1-6}$ alkyl), —OC(═O)($C_{1-6}$ alkyl), —$OCO_2$($C_{1-6}$ alkyl), —C(═O)$NH_2$, —C(═O)N($C_{1-6}$ alkyl)$_2$, —OC(═O)NH($C_{1-6}$ alkyl), —NHC(═O)($C_{1-6}$ alkyl), —N($C_{1-6}$ alkyl)C(═O)($C_{1-6}$ alkyl), —$NHCO_2$($C_{1-6}$ alkyl), —NHC(═O)N($C_{1-6}$ alkyl)$_2$, —NHC (=O)NH($C_{1-6}$ alkyl), —NHC(=O)$NH_2$, —C(=NH)O($C_{1-6}$ alkyl), —OC(=NH)($C_{1-6}$ alkyl), —OC(=NH)O$C_{1-6}$ alkyl, —C(=NH)N($C_{1-6}$ alkyl)$_2$, —C(=NH)NH($C_{1-6}$ alkyl), —C(=NH)$NH_2$, —OC(=NH)N($C_{1-6}$ alkyl)$_2$, —OC(=NH)NH($C_{1-6}$ alkyl), —OC(=NH)$NH_2$, —NHC(=NH)N($C_{1-6}$ alkyl)$_2$, —NHC(=NH)$NH_2$, —$NHSO_2$($C_{1-6}$ alkyl), —$SO_2$N($C_{1-6}$ alkyl)$_2$, —$SO_2$NH($C_{1-6}$ alkyl), —$SO_2NH_2$, —$SO_2$($C_{1-6}$ alkyl), —$SO_2$O($C_{1-6}$ alkyl), —$OSO_2$($C_{1-6}$ alkyl), —SO($C_{1-6}$ alkyl), —Si($C_{1-6}$ alkyl)$_3$, —OSi($C_{1-6}$ alkyl)$_3$-C(=S)N($C_{1-6}$ alkyl)$_2$, C(=S)NH($C_{1-6}$ alkyl), C(=S)$NH_2$, —C(=O)S($C_{1-6}$ alkyl), —C(=S)S$C_{1-6}$ alkyl, —SC(=S)S$C_{1-6}$ alkyl, —P(=O)(O$C_{1-6}$ alkyl)$_2$, —P(=O)($C_{1-6}$ alkyl)$_2$, —OP(=O)($C_{1-6}$ alkyl)$_2$, —OP(=O)(O$C_{1-6}$ alkyl)$_2$, $C_{1-6}$ alkyl, $C_{1-6}$ perhaloalkyl, $C_{2-6}$ alkenyl, $C_{2-6}$ alkynyl, hetero$C_{1-6}$ alkyl, hetero$C_{2-6}$ alkenyl, hetero$C_{2-6}$ alkynyl, $C_{3-10}$ carbocyclyl, $C_{6-10}$ aryl, 3-10 membered heterocyclyl, 5-10 membered heteroaryl; or two geminal $R^{99}$ substituents can be joined to form =O or =S; wherein $X^-$ is a counterion.

In certain embodiments, an exemplary carbon atom substituent is halogen (.e.g, —F, —Cl, —Br, —I), —CN, —$NO_2$, —$N_3$, —$SO_2H$, —$SO_3H$, —OH, —O($C_{1-6}$ alkyl) (e.g., —OMe), —$NH_2$, —SH, —S($C_{1-6}$ alkyl) (e.g., —SMe), —C(=O)($C_{1-6}$ alkyl) (e.g., —C(=O)Me), —$CO_2H$, or —CHO.

The term "halo" or "halogen" refers to fluorine (fluoro, —F), chlorine (chloro, —$C_1$), bromine (bromo, —Br), or iodine (iodo, —I).

The term "hydroxyl" or "hydroxy" refers to the group —OH. The term "substituted hydroxyl" or "substituted hydroxyl," by extension, refers to a hydroxyl group wherein the oxygen atom directly attached to the parent molecule is substituted with a group other than hydrogen, and includes groups selected from —$OR^{aa}$, —ON($R^{bb}$)$_2$, —OC(=O)$SR^{aa}$, —OC(=O)$R^{aa}$, —$OCO_2R^{aa}$, —OC(=O)N($R^{bb}$)$_2$, —OC(=$NR^{bb}$)$R^{aa}$, —OC(=$NR^{bb}$)$OR^{aa}$, —OC(=$NR^{bb}$)N($R^{bb}$)$_2$, —OS(=O)$R^{aa}$, —$OSO_2R^{aa}$, —OSi($R^{aa}$)$_3$; —OP($R^{cc}$)$_2$, —OP($R^{cc}$)$_3^+X^-$, —OP($OR^{cc}$)$_2$, —OP($OR^{cc}$)$_3^+X^-$, —OP(=O)($R^{aa}$)$_2$, —OP(=O)($OR^{cc}$)$_2$, and —OP(=O)(N($R^{bb}$)$_2$)$_2$, wherein $X^-$, $R^{aa}$, $R^{bb}$, and $R^{cc}$ are as defined herein.

The term "amino" refers to the group —$NH_2$. The term "substituted amino," by extension, refers to a monosubstituted amino, a disubstituted amino, or a trisubstituted amino. In certain embodiments, the "substituted amino" is a monosubstituted amino or a disubstituted amino group.

The term "monosubstituted amino" refers to an amino group wherein the nitrogen atom directly attached to the parent molecule is substituted with one hydrogen and one group other than hydrogen, and includes groups selected from —NH($R^{bb}$), —NHC(=O)$R^{aa}$, —$NHCO_2R^{aa}$, —NHC(=O)N($R^{bb}$)$_2$, —NHC(=$NR^{bb}$)N($R^{bb}$)$_2$, —$NHSO_2R^{aa}$, —NHP(=O)($OR^{cc}$)$_2$, and —NHP(=O)(N($R^{bb}$)$_2$)$_2$, wherein $R^{aa}$, $R^{bb}$ and $R^{cc}$ are as defined herein, and wherein $R^{bb}$ of the group —NH($R^{bb}$) is not hydrogen.

The term "disubstituted amino" refers to an amino group wherein the nitrogen atom directly attached to the parent molecule is substituted with two groups other than hydrogen, and includes groups selected from —N($R^{bb}$)$_2$, —$NR^{bb}$C(=O)$R^{aa}$, —$NR^{bb}CO_2R^{aa}$, —$NR^{bb}$C(=O)N($R^{bb}$)$_2$, —$NR^{bb}$C(=$NR^{bb}$)N($R^{bb}$)$_2$, —$NR^{bb}SO_2R^{aa}$, —$NR^{bb}$P(=O)($OR^{cc}$)$_2$, and —$NR^{bb}$P(=O)(N($R^{bb}$)$_2$)$_2$, wherein $R^{aa}$, $R^{bb}$, and $R^{cc}$ are as defined herein, with the proviso that the nitrogen atom directly attached to the parent molecule is not substituted with hydrogen.

The term "trisubstituted amino" refers to an amino group wherein the nitrogen atom directly attached to the parent molecule is substituted with three groups, and includes groups selected from —N($R^{bb}$)$_3$ and —N($R^{bb}$)$_3^+X^-$, wherein $R^{bb}$ and $X^-$ are as defined herein.

The term "acyl" refers to a group having the general formula: —C(=O)$R^{X1}$, —C(=O)$OR^{X1}$, —C(=O)—O—C(=O)$R^{X1}$, —C(=O)$SR^{X1}$, —C(=O)N($R^{X1}$)$_2$, —C(=S)$R^{X1}$, —C(=S)N($R^{X1}$)$_2$, —C(=S)O($R^{X1}$), —C(=S)S($R^{X1}$), —C(=$NR^{X1}$)$R^{X1}$, —C(=$NR^{X1}$)$OR^{X1}$, —C(=$NR^{X1}$)$SR^{X1}$, or —C(=$NR^{X1}$)N($R^{X1}$)$_2$, wherein $R^{X1}$ is hydrogen; halogen; substituted or unsubstituted hydroxyl; substituted or unsubstituted thiol; substituted or unsubstituted amino; substituted or unsubstituted acyl, cyclic or acyclic, substituted or unsubstituted, branched or unbranched aliphatic; cyclic or acyclic, substituted or unsubstituted, branched or unbranched heteroaliphatic; cyclic or acyclic, substituted or unsubstituted, branched or unbranched alkyl; cyclic or acyclic, substituted or unsubstituted, branched or unbranched alkenyl; substituted or unsubstituted alkynyl; substituted or unsubstituted aryl, substituted or unsubstituted heteroaryl, aliphaticoxy, heteroaliphaticoxy, alkyloxy, heteroalkyloxy, aryloxy, heteroaryloxy, aliphaticthioxy, heteroaliphaticthioxy, alkylthioxy, heteroalkylthioxy, arylthioxy, heteroarylthioxy, mono- or di-aliphaticamino, mono- or di-heteroaliphaticamino, mono- or di-alkylamino, mono- or di-heteroalkylamino, mono- or di-arylamino, or mono- or di-heteroarylamino; or two $R^{X1}$ groups taken together form a 5- to 6-membered heterocyclic ring. Exemplary acyl groups include aldehydes (—CHO), carboxylic acids (—$CO_2H$), ketones, acyl halides, esters, amides, imines, carbonates, carbamates, and ureas. Acyl substituents include, but are not limited to, any of the substituents described herein, that result in the formation of a stable moiety (e.g., aliphatic, alkyl, alkenyl, alkynyl, heteroaliphatic, heterocyclic, aryl, heteroaryl, acyl, oxo, imino, thiooxo, cyano, isocyano, amino, azido, nitro, hydroxyl, thiol, halo, aliphaticamino, heteroaliphaticamino, alkylamino, heteroalkylamino, arylamino, heteroarylamino, alkylaryl, arylalkyl, aliphaticoxy, heteroaliphaticoxy, alkyloxy, heteroalkyloxy, aryloxy, heteroaryloxy, aliphaticthioxy, heteroaliphaticthioxy, alkylthioxy, heteroalkylthioxy, arylthioxy, heteroarylthioxy, acyloxy, and the like, each of which may or may not be further substituted).

The term "oxo" refers to the group =O, and the term "thiooxo" refers to the group =S.

Nitrogen atoms can be substituted or unsubstituted as valency permits, and include primary, secondary, tertiary, and quaternary nitrogen atoms. Exemplary nitrogen atom substituents include, but are not limited to, hydrogen, —OH, —$OR^{aa}$, —N($R^{cc}$)$_2$, —CN, —C(=O)$R^{aa}$, —C(=O)N($R^{cc}$)$_2$, —$CO_2R^{aa}$, —$SO_2R^{aa}$, —C(=$NR^{bb}$)$R^{aa}$, —C(=$NR^{cc}$)$OR^{aa}$, —C(=$NR^{cc}$)N($R^{cc}$)$_2$, —$SO_2$N($R^{cc}$)$_2$, —$SO_2R^{cc}$, —$SO_2OR^{cc}$, —$SOR^{aa}$, —C(=S)N($R^{cc}$)$_2$, —C(=O)$SR^{cc}$, —C(=S)$SR^{cc}$, —P(=O)($OR^{cc}$)$_2$, —P(=O)($R^{cc}$)$_2$, —P(=O)(N($R^{cc}$)$_2$)$_2$, $C_{1-10}$ alkyl, $C_{1-10}$ perhaloalkyl, $C_{2-10}$ alkenyl, $C_{2-10}$ alkynyl, hetero$C_{1-10}$alkyl, hetero$C_{2-10}$alkenyl, hetero$C_{2-10}$alkynyl, $C_{3-10}$ carbocyclyl, 3-14 membered heterocyclyl, $C_{6-14}$ aryl, and 5-14 membered heteroaryl, or two $R^{cc}$ groups attached to an N atom are joined to form a 3-14 membered heterocyclyl or 5-14 membered heteroaryl ring, wherein each alkyl, alkenyl, alkynyl, heteroalkyl, heteroalkenyl, heteroalkynyl, carbocyclyl, heterocyclyl, aryl, and heteroaryl is independently substituted with 0, 1, 2, 3, 4, or 5 $R^{dd}$ groups, and wherein $R^{aa}$, $R^{bb}$, $R^{cc}$ and $R^{dd}$ are as defined herein.

In certain embodiments, the substituent present on the nitrogen atom is a nitrogen protecting group (also referred to herein as an "amino protecting group"). Nitrogen protecting groups include, but are not limited to, —OH, —$OR^{aa}$, —$N(R^{cc})_2$, —C(=O)$R^{aa}$, —C(=O)$N(R^{cc})_2$, —$CO_2R^{aa}$, —$SO_2R^{aa}$, —C(=$NR^{cc}$)$R^{aa}$, —C(=$NR^{cc}$)$OR^{aa}$, —C(=$NR^{cc}$)$N(R^{cc})_2$, —$SO_2N(R^{cc})_2$, —$SO_2R^{cc}$, —$SO_2OR^{cc}$, —$SOR^{aa}$, —C(=S)$N(R^{cc})_2$, —C(=O)$SR^{cc}$, —C(=S)$SR^{cc}$, $C_{1-10}$ alkyl (e.g., aralkyl, heteroaralkyl), $C_{2-10}$ alkenyl, $C_{2-10}$ alkynyl, hetero$C_{1-10}$alkyl, hetero$C_{2-10}$ alkenyl, hetero$C_{2-10}$ alkynyl, $C_{3-10}$ carbocyclyl, 3-14 membered heterocyclyl, $C_{6-14}$ aryl, and 5-14 membered heteroaryl groups, wherein each alkyl, alkenyl, alkynyl, heteroalkyl, heteroalkenyl, heteroalkynyl, carbocyclyl, heterocyclyl, aralkyl, aryl, and heteroaryl is independently substituted with 0, 1, 2, 3, 4, or 5 $R^{dd}$ groups, and wherein $R^{aa}$, $R^{bb}$, $R^{cc}$ and $R^{dd}$ are as defined herein. Nitrogen protecting groups are well known in the art and include those described in detail in *Protecting Groups in Organic Synthesis*, T. W. Greene and P. G. M. Wuts, $3^{rd}$ edition, John Wiley & Sons, 1999, incorporated herein by reference.

For example, nitrogen protecting groups such as amide groups (e.g., —C(=O)$R^{aa}$) include, but are not limited to, formamide, acetamide, chloroacetamide, trichloroacetamide, trifluoroacetamide, phenylacetamide, 3-phenylpropanamide, picolinamide, 3-pyridylcarboxamide, N-benzoylphenylalanyl derivative, benzamide, p-phenylbenzamide, o-nitophenylacetamide, o-nitrophenoxyacetamide, acetoacetamide, (N'-dithiobenzyloxyacylamino)acetamide, 3-(p-hydroxyphenyl)propanamide, 3-(o-nitrophenyl)propanamide, 2-methyl-2-(o-nitrophenoxy)propanamide, 2-methyl-2-(o-phenylazophenoxy)propanamide, 4-chlorobutanamide, 3-methyl-3-nitrobutanamide, o-nitrocinnamide, N-acetylmethionine derivative, o-nitrobenzamide and o-(benzoyloxymethyl)benzamide.

Nitrogen protecting groups such as carbamate groups (e.g., —C(=O)$OR^{aa}$) include, but are not limited to, methyl carbamate, ethyl carbamate, 9-fluorenylmethyl carbamate (Fmoc), 9-(2-sulfo)fluorenylmethyl carbamate, 9-(2,7-dibromo)fluorenylmethyl carbamate, 2,7-di-t-butyl-[9-(10,10-dioxo-10,10,10,10-tetrahydrothioxanthyl)]methyl carbamate (DBD-Tmoc), 4-methoxyphenacyl carbamate (Phenoc), 2,2,2-trichloroethyl carbamate (Troc), 2-trimethylsilylethyl carbamate (Teoc), 2-phenylethyl carbamate (hZ), 1-(1-adamantyl)-1-methylethyl carbamate (Adpoc), 1,1-dimethyl-2-haloethyl carbamate, 1,1-dimethyl-2,2-dibromoethyl carbamate (DB-t-BOC), 1,1-dimethyl-2,2,2-trichloroethyl carbamate (TCBOC), 1-methyl-1-(4-biphenylyl)ethyl carbamate (Bpoc), 1-(3,5-di-t-butylphenyl)-1-methylethyl carbamate (t-Bumeoc), 2-(2'- and 4'-pyridyl)ethyl carbamate (Pyoc), 2-(N,N-dicyclohexylcarboxamido)ethyl carbamate, t-butyl carbamate (BOC or Boc), 1-adamantyl carbamate (Adoc), vinyl carbamate (Voc), allyl carbamate (Alloc), 1-isopropylallyl carbamate (Ipaoc), cinnamyl carbamate (Coc), 4-nitrocinnamyl carbamate (Noc), 8-quinolyl carbamate, N-hydroxypiperidinyl carbamate, alkyldithio carbamate, benzyl carbamate (Cbz), p-methoxybenzyl carbamate (Moz), p-nitrobenzyl carbamate, p-bromobenzyl carbamate, p-chlorobenzyl carbamate, 2,4-dichlorobenzyl carbamate, 4-methylsulfinylbenzyl carbamate (Msz), 9-anthrylmethyl carbamate, diphenylmethyl carbamate, 2-methylthioethyl carbamate, 2-methylsulfonylethyl carbamate, 2-(p-toluenesulfonyl)ethyl carbamate, [2-(1,3-dithianyl)]methyl carbamate (Dmoc), 4-methylthiophenyl carbamate (Mtpc), 2,4-dimethylthiophenyl carbamate (Bmpc), 2-phosphonioethyl carbamate (Peoc), 2-triphenylphosphonioisopropyl carbamate (Ppoc), 1,1-dimethyl-2-cyanoethyl carbamate, m-chloro-p-acyloxybenzyl carbamate, p-(dihydroxyboryl)benzyl-carbamate, 5-benzisoxazolylmethyl carbamate, 2-(trifluoromethyl)-6-chromonylmethyl carbamate (Tcroc), m-nitrophenyl carbamate, 3,5-dimethoxybenzyl carbamate, o-nitrobenzyl carbamate, 3,4-dimethoxy-6-nitrobenzyl carbamate, phenyl(o-nitrophenyl)methyl carbamate, t-amyl carbamate, S-benzyl thiocarbamate, p-cyanobenzyl carbamate, cyclobutyl carbamate, cyclohexyl carbamate, cyclopentyl carbamate, cyclopropylmethyl carbamate, p-decyloxybenzyl carbamate, 2,2-dimethoxyacylvinyl carbamate, o-(N,N-dimethylcarboxamido)benzyl carbamate, 1,1-dimethyl-3-(N,N-dimethylcarboxamido)propyl carbamate, 1,1-dimethylpropynyl carbamate, di(2-pyridyl)methyl carbamate, 2-furanylmethyl carbamate, 2-iodoethyl carbamate, isobornyl carbamate, isobutyl carbamate, isonicotinyl carbamate, p-(p'-methoxyphenylazo)benzyl carbamate, 1-methylcyclobutyl carbamate, 1-methylcyclohexyl carbamate, 1-methyl-1-cyclopropylmethyl carbamate, 1-methyl-1-(3,5-dimethoxyphenyl)ethyl carbamate, 1-methyl-1-(p-phenylazophenyl)ethyl carbamate, 1-methyl-1-phenylethyl carbamate, 1-methyl-1-(4-pyridyl)ethyl carbamate, phenyl carbamate, p-(phenylazo)benzyl carbamate, 2,4,6-tri-t-butylphenyl carbamate, 4-(trimethylammonium)benzyl carbamate, and 2,4,6-trimethylbenzyl carbamate.

Nitrogen protecting groups such as sulfonamide groups (e.g., —S(=O)$_2R^{aa}$) include, but are not limited to, p-toluenesulfonamide (Ts), benzenesulfonamide, 2,3,6-trimethyl-4-methoxybenzenesulfonamide (Mtr), 2,4,6-trimethoxybenzenesulfonamide (Mtb), 2,6-dimethyl-4-methoxybenzenesulfonamide (Pme), 2,3,5,6-tetramethyl-4-methoxybenzenesulfonamide (Mte), 4-methoxybenzenesulfonamide (Mbs), 2,4,6-trimethylbenzenesulfonamide (Mts), 2,6-dimethoxy-4-methylbenzenesulfonamide (iMds), 2,2,5,7,8-pentamethylchroman-6-sulfonamide (Pmc), methanesulfonamide (Ms), β-trimethylsilylethanesulfonamide (SES), 9-anthracenesulfonamide, 4-(4',8'-dimethoxynaphthylmethyl)benzenesulfonamide (DNMBS), benzylsulfonamide, trifluoromethylsulfonamide, and phenacylsulfonamide.

Other nitrogen protecting groups include, but are not limited to, phenothiazinyl-(10)-acyl derivative, N'-p-toluenesulfonylaminoacyl derivative, N'-phenylaminothioacyl derivative, N-benzoylphenylalanyl derivative, N-acetylmethionine derivative, 4,5-diphenyl-3-oxazolin-2-one, N-phthalimide, N-dithiasuccinimide (Dts), N-2,3-diphenylmaleimide, N-2,5-dimethylpyrrole, N-1,1,4,4-tetramethyldisilylazacyclopentane adduct (STABASE), 5-substituted 1,3-dimethyl-1,3,5-triazacyclohexan-2-one, 5-substituted 1,3-dibenzyl-1,3,5-triazacyclohexan-2-one, 1-substituted 3,5-dinitro-4-pyridone, N-methylamine, N-allylamine, N-[2-(trimethylsilyl)ethoxy]methylamine (SEM), N-3-acetoxypropylamine, N-(1-isopropyl-4-nitro-2-oxo-3-pyrrolin-3-yl)amine, quaternary ammonium salts, N-benzylamine, N-di(4-methoxyphenyl)methylamine, N-5-dibenzosuberylamine, N-triphenylmethylamine (Tr), N-[(4-methoxyphenyl)diphenylmethyl]amine (MMTr), N-9-phenylfluorenylamine (PhF), N-2,7-dichloro-9-fluorenylmethyleneamine, N-ferrocenylmethylamino (Fcm), N-2-picolylamino N'-oxide, N-1,1-dimethylthiomethyleneamine, N-benzylideneamine, N-p-methoxybenzylideneamine, N-diphenylmethyleneamine, N-[(2-pyridyl)mesityl]methyleneamine, N—(N',N'-dimethylaminomethylene)amine, N,N'-isopropylidenediamine, N-p-nitrobenzylideneamine, N-salicylideneamine, N-5-chlorosalicylideneamine, N-(5-chloro-2-hydroxyphenyl)phenylmethyleneamine, N-cyclohexylideneamine, N-(5,5-dimethyl-3-oxo-1-cyclohexenyl)amine, N-borane derivative, N-diphenylborinic acid derivative, N-[phenyl(pentaacylchromium- or tungsten)acyl]amine, N-copper chelate, N-zinc chelate, N-nitroamine, N-nitrosoamine, amine N-oxide, diphenylphosphinamide (Dpp), dimethylthiophosphinamide (Mpt), diphenylthiophosphinamide (Ppt), dialkyl phosphoramidates, dibenzyl phosphoramidate, diphenyl phosphoramidate, benzenesulfenamide, o-nitrobenzenesulfenamide (Nps), 2,4-dinitrobenzenesulfenamide, pentachlorobenzenesulfenamide, 2-nitro-4-methoxybenzenesulfenamide, triphenylmethylsulfenamide, and 3-nitropyridinesulfenamide (Npys). In certain embodiments, a nitrogen protecting group is benzyl (Bn), tert-butyloxycarbonyl (BOC), carbobenzyloxy (Cbz), 9-flurenylmethyloxycarbonyl (Fmoc), trifluoroacetyl, triphenylmethyl, acetyl (Ac), benzoyl (Bz), p-methoxybenzyl (PMB), 3,4-dimethoxybenzyl (DMPM), p-methoxyphenyl (PMP), 2,2,2-trichloroethyloxycarbonyl (Troc), triphenylmethyl (Tr), tosyl (Ts), brosyl (Bs), nosyl (Ns), mesyl (Ms), triflyl (Tf), or dansyl (Ds).

In certain embodiments, the substituent present on an oxygen atom is an oxygen protecting group (also referred to herein as an "hydroxyl protecting group"). Oxygen protecting groups include, but are not limited to, $-R^{aa}$, $-N(R^{bb})_2$, $-C(=O)SR^{aa}$, $-C(=O)R^{aa}$, $-CO_2R^{aa}$, $-C(=O)N(R^{bb})_2$, $-C(=NR^{bb})R^{aa}$, $-C(=NR^{bb})OR^{aa}$, $-C(=NR^{bb})N(R^{bb})_2$, $-S(=O)R^{aa}$, $-SO_2R^{aa}$, $-Si(R^{aa})_3$, $-P(R^{cc})_2$, $-P(R^{cc})_3^+X^-$, $-P(OR^{cc})_2$, $-P(OR^{cc})_3^+X^-$, $-P(=O)(R^{aa})_2$, $-P(=O)(OR^{cc})_2$, and $-P(=O)(N(R^{bb})_2)_2$, wherein $X^-$, $R^{aa}$, $R^{bb}$, and $R^{cc}$ are as defined herein. Oxygen protecting groups are well known in the art and include those described in detail in *Protecting Groups in Organic Synthesis*, T. W. Greene and P. G. M. Wuts, 3rd edition, John Wiley & Sons, 1999, incorporated herein by reference.

Exemplary oxygen protecting groups include, but are not limited to, methyl, methoxylmethyl (MOM), methylthiomethyl (MTM), t-butylthiomethyl, (phenyldimethylsilyl) methoxymethyl (SMOM), benzyloxymethyl (BOM), p-methoxybenzyloxymethyl (PMBM), (4-methoxyphenoxy)methyl (p-AOM), guaiacolmethyl (GUM), t-butoxymethyl, 4-pentenyloxymethyl (POM), siloxymethyl, 2-methoxyethoxymethyl (MEM), 2,2,2-trichloroethoxymethyl, bis(2-chloroethoxy)methyl, 2-(trimethylsilyl) ethoxymethyl (SEMOR), tetrahydropyranyl (THP), 3-bromotetrahydropyranyl, tetrahydrothiopyranyl, 1-methoxycyclohexyl, 4-methoxytetrahydropyranyl (MTHP), 4-methoxytetrahydrothiopyranyl, 4-methoxytetrahydrothiopyranyl S,S-dioxide, 1-[(2-chloro-4-methyl)phenyl]-4-methoxypiperidin-4-yl (CTMP), 1,4-dioxan-2-yl, tetrahydrofuranyl, tetrahydrothiofuranyl, 2,3,3a,4,5,6,7,7a-octahydro-7,8,8-trimethyl-4,7-methanobenzofuran-2-yl, 1-ethoxyethyl, 1-(2-chloroethoxy)ethyl, 1-methyl-1-methoxyethyl, 1-methyl-1-benzyloxyethyl, 1-methyl-1-benzyloxy-2-fluoroethyl, 2,2,2-trichloroethyl, 2-trimethylsilylethyl, 2-(phenylselenyl)ethyl, t-butyl, allyl, p-chlorophenyl, p-methoxyphenyl, 2,4-dinitrophenyl, benzyl (Bn), p-methoxybenzyl, 3,4-dimethoxybenzyl, o-nitrobenzyl, p-nitrobenzyl, p-halobenzyl, 2,6-dichlorobenzyl, p-cyanobenzyl, p-phenylbenzyl, 2-picolyl, 4-picolyl, 3-methyl-2-picolyl N-oxido, diphenylmethyl, p,p'-dinitrobenzhydryl, 5-dibenzosuberyl, triphenylmethyl, α-naphthyldiphenylmethyl, p-methoxyphenyldiphenylmethyl, di(p-methoxyphenyl)phenylmethyl, tri(p-methoxyphenyl)methyl, 4-(4'-bromophenacyloxyphenyl)diphenylmethyl, 4,4',4"-tris(4,5-dichlorophthalimidophenyl)methyl, 4,4',4"-tris (levulinoyloxyphenyl)methyl, 4,4',4"-tris (benzoyloxyphenyl)methyl, 3-(imidazol-1-yl)bis(4',4"-dimethoxyphenyl)methyl, 1,1-bis(4-methoxyphenyl)-1'-pyrenylmethyl, 9-anthryl, 9-(9-phenyl)xanthenyl, 9-(9-phenyl-10-oxo)anthryl, 1,3-benzodithiolan-2-yl, benzisothiazolyl S,S-dioxido, trimethylsilyl (TMS), triethylsilyl (TES), triisopropylsilyl (TIPS), dimethylisopropylsilyl (IPDMS), diethylisopropylsilyl (DEIPS), dimethylthexylsilyl, t-butyldimethylsilyl (TBDMS), t-butyldiphenylsilyl (TBDPS), tribenzylsilyl, tri-p-xylylsilyl, triphenylsilyl, diphenylmethylsilyl (DPMS), t-butylmethoxyphenylsilyl (TBMPS), formate, benzoylformate, acetate, chloroacetate, dichloroacetate, trichloroacetate, trifluoroacetate, methoxyacetate, triphenylmethoxyacetate, phenoxyacetate, p-chlorophenoxyacetate, 3-phenylpropionate, 4-oxopentanoate (levulinate), 4,4-(ethylenedithio)pentanoate (levulinoyldithioacetal), pivaloate, adamantoate, crotonate, 4-methoxycrotonate, benzoate, p-phenylbenzoate, 2,4,6-trimethylbenzoate (mesitoate), methyl carbonate, 9-fluorenylmethyl carbonate (Fmoc), ethyl carbonate, 2,2,2-trichloroethyl carbonate (Troc), 2-(trimethylsilyl)ethyl carbonate (TMSEC), 2-(phenylsulfonyl) ethyl carbonate (Psec), 2-(triphenylphosphonio) ethyl carbonate (Peoc), isobutyl carbonate, vinyl carbonate, allyl carbonate, t-butyl carbonate (BOC or Boc), p-nitrophenyl carbonate, benzyl carbonate, p-methoxybenzyl carbonate, 3,4-dimethoxybenzyl carbonate, o-nitrobenzyl carbonate, p-nitrobenzyl carbonate, S-benzyl thiocarbonate, 4-ethoxy-1-napththyl carbonate, methyl dithiocarbonate, 2-iodobenzoate, 4-azidobutyrate, 4-nitro-4-methylpentanoate, o-(dibromomethyl)benzoate, 2-formylbenzenesulfonate, 2-(methylthiomethoxy)ethyl, 4-(methylthiomethoxy)butyrate, 2-(methylthiomethoxymethyl)benzoate, 2,6-dichloro-4-methylphenoxyacetate, 2,6-dichloro-4-(1,1,3,3-tetramethylbutyl)phenoxyacetate, 2,4-bis(1,1-dimethylpropyl)phenoxyacetate, chlorodiphenylacetate, isobutyrate, monosuccinoate, (E)-2-methyl-2-butenoate, o-(methoxyacyl)benzoate, α-naphthoate, nitrate, alkyl N,N,N',N'-tetramethylphosphorodiamidate, alkyl N-phenylcarbamate, borate, dimethylphosphinothioyl, alkyl 2,4-dinitrophenylsulfenate, sulfate, methanesulfonate (mesylate), benzylsulfonate, and tosylate (Ts). In certain embodiments, an oxygen protecting group is silyl. In certain embodiments, an oxygen protecting group is t-butyldiphenylsilyl (TBDPS), t-butyldimethylsilyl (TBDMS), triisoproylsilyl (TIPS), triphenylsilyl (TPS), triethylsilyl (TES), trimethylsilyl (TMS), triisopropylsiloxymethyl (TOM), acetyl (Ac), benzoyl (Bz), allyl carbonate, 2,2,2-trichloroethyl carbonate (Troc), 2-trimethylsilylethyl carbonate, methoxymethyl (MOM), 1-ethoxyethyl (EE), 2-methyoxy-2-propyl (MOP), 2,2,2-trichloroethoxyethyl, 2-methoxyethoxymethyl (MEM), 2-trimethylsilylethoxymethyl (SEM), methylthiomethyl (MTM), tetrahydropyranyl (THP), tetrahydrofuranyl (THF), p-methoxyphenyl (PMP), triphenylmethyl (Tr), methoxytrityl (MMT), dimethoxytrityl (DMTr), allyl, p-methoxybenzyl (PMB), t-butyl, benzyl (Bn), allyl, or pivaloyl (Piv).

In certain embodiments, the substituent present on a sulfur atom is a sulfur protecting group (also referred to as a "thiol protecting group"). Sulfur protecting groups include, but are not limited to, $-R^{aa}$, $-N(R^{bb})_2$, $-C(=O)SR^{aa}$, $-C(=O)R^{aa}$, $-CO_2R^{aa}$, $-C(=O)N(R^{bb})_2$, $-C(=NR^{bb})R^{aa}$, $-C(=NR^{bb})OR^{aa}$, $-C(=NR^{bb})N(R^{bb})_2$, $-S(=O)R^{aa}$, $-SO_2R^{aa}$, $-Si(R^{aa})_3$, $-P(R^{cc})_2$, $-P(R^{cc})_3^+X^-$, $-P(OR^{cc})_2$, $-P(OR^{cc})_3^+X^-$, $-P(=O)(R^{aa})_2$, $-P(=O)(OR^{cc})_2$, and $-P(=O)(N(R^{bb})_2)_2$, wherein $R^{aa}$, $R^{bb}$, and $R^{cc}$ are as defined herein. Sulfur protecting groups are well known in the art and include those described in detail in *Protecting Groups in Organic Synthesis*, T. W. Greene and P. G. M. Wuts, 3rd edition, John Wiley & Sons, 1999, incorporated herein by reference. In certain embodiments, a sulfur protecting group is acetamidomethyl, t-Bu, 3-nitro-2-pyridine sulfenyl, 2-pyridine-sulfenyl, or triphenylmethyl.

A "counterion" or "anionic counterion" is a negatively charged group associated with a positively charged group in order to maintain electronic neutrality. An anionic counterion may be monovalent (i.e., including one formal negative charge). An anionic counterion may also be multivalent (i.e., including more than one formal negative charge), such as divalent or trivalent. Exemplary counterions include halide ions (e.g., $F^-$, $Cl^-$, $Br^-$, $I^-$), $NO_3^-$, $ClO_4^-$, $OH^-$, $H_2PO_4^-$, $HCO_3^-$, $HSO_4^-$, sulfonate ions (e.g., methansulfonate, trifluoromethanesulfonate, p-toluenesulfonate, benzenesulfonate, 10-camphor sulfonate, naphthalene-2-sulfonate, naphthalene-1-sulfonic acid-5-sulfonate, ethan-1-sulfonic acid-2-sulfonate, and the like), carboxylate ions (e.g., acetate, propanoate, benzoate, glycerate, lactate, tartrate, glycolate, gluconate, and the like), $BF_4^-$, $PF_4^-$, $PF_6^-$, $AsF_6^-$, $SbF_6^-$, $B[3,5-(CF_3)_2C_6H_3]_4]^-$, $B(C_6F_5)_4^-$, $BPh_4^-$, $Al(OC(CF_3)_3)_4^-$, and carborane anions (e.g., $CB_{11}H_{12}^-$ or $(HCB_{11}Me_5Br_6)^-$). Exemplary counterions which may be multivalent include $CO_3^{2-}$, $HPO_4^{2-}$, $P_4^{3-}$, $B_4O_7^{2-}$, $SO_4^{2-}$, $S_2O_3^{2-}$, carboxylate anions (e.g., tartrate, citrate, fumarate, maleate, malate, malonate, gluconate, succinate, glutarate, adipate, pimelate, suberate, azelate, sebacate, salicylate, phthalates, aspartate, glutamate, and the like), and carboranes.

As used herein, the term "salt" refers to any and all salts, and encompasses pharmaceutically acceptable salts.

The term "pharmaceutically acceptable salt" refers to those salts which are, within the scope of sound medical judgment, suitable for use in contact with the tissues of humans and/or animals without undue toxicity, irritation, allergic response, and the like, and are commensurate with a reasonable benefit/risk ratio. Pharmaceutically acceptable salts are well known in the art. For example, Berge et al. describe pharmaceutically acceptable salts in detail in *J. Pharmaceutical Sciences,* 1977, 66, 1-19, incorporated herein by reference. Pharmaceutically acceptable salts of the compounds of this disclosure include those derived from suitable inorganic and organic acids and bases. Examples of pharmaceutically acceptable, nontoxic acid addition salts are salts of an amino group formed with inorganic acids, such as hydrochloric acid, hydrobromic acid, phosphoric acid, sulfuric acid, and perchloric acid or with organic acids, such as acetic acid, oxalic acid, maleic acid, tartaric acid, citric acid, succinic acid, or malonic acid or by using other methods known in the art such as ion exchange. Other pharmaceutically acceptable salts include adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, formate, fumarate, glucoheptonate, glycerophosphate, gluconate, hemisulfate, heptanoate, hexanoate, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, p-toluenesulfonate, undecanoate, valerate salts, and the like. Salts derived from appropriate bases include alkali metal, alkaline earth metal, ammonium, and $N^+(C_{1-4}\ alkyl)_4^-$ salts. Representative alkali or alkaline earth metal salts include sodium, lithium, potassium, calcium, magnesium, and the like. Further pharmaceutically acceptable salts include, when appropriate, nontoxic ammonium, quaternary ammonium, and amine cations formed using counterions such as halide, hydroxide, carboxylate, sulfate, phosphate, nitrate, lower alkyl sulfonate, and aryl sulfonate.

It is also to be understood that compounds that have the same molecular formula but differ in the nature or sequence of bonding of their atoms or the arrangement of their atoms in space are termed "isomers". Isomers that differ in the arrangement of their atoms in space are termed "stereoisomers".

Stereoisomers that are not mirror images of one another are termed "diastereomers" and those that are non-superimposable mirror images of each other are termed "enantiomers". When a compound has an asymmetric center, for example, it is bonded to four different groups, a pair of enantiomers is possible. An enantiomer can be characterized by the absolute configuration of its asymmetric center and is described by the R- and S-sequencing rules of Cahn and Prelog, or by the manner in which the molecule rotates the plane of polarized light and designated as dextrorotatory or levorotatory (i.e., as (+) or (−)-isomers respectively). A chiral compound can exist as either individual enantiomer or as a mixture thereof. A mixture containing equal proportions of the enantiomers is called a "racemic mixture".

The term "Cytochrome P450 family 7 subfamily A member 1," used interchangeably with the term "CYP7A1," refers to the well-known gene and polypeptide, also known in the art as Cytochrome P450 family 7 subfamily A member 1.

The term "CYP7A1" includes human (*Homo sapiens*) CYP7A1, the amino acid and nucleotide sequence of which may be found in, for example, GenBank Accession No. GI: 1581, NCBI Accession Nos. NP_000771.2 and NM_000780.4, UniProt ID: P22680; mouse (*Mus musculus*) CYP7A1, the amino acid and nucleotide sequence of which may be found in, for example, GenBank Accession No. GI: 13122, NCBI Accession Nos. NP_031850.2 and NM_007824.3; UniProt ID: Q64505; rat (*Rattus norvegicus*) CYP7A1, the amino acid and nucleotide sequence of which may be found in, for example, GenBank Accession No. GI: 25428, NCBI Accession No. NP_037074.1 and NM_012942.2, UniProt ID: P18125; and chimpanzee (*Pan troglodytes*) CYP7A1, the amino acid and nucleotide sequence of which may be found in, for example, GenBank Accession No. GI: 464191, NCBI Accession No. XM_519773.3, UniProt ID: H2QW73. The term "CYP7A1" also includes cynomolgus monkey (*Macaca fascicularis*) CYP7A1, the amino acid and nucleotide sequence of which may be found in, for example, GenBank Accession No. GI: 102132452, NCBI Accession No. XP_005563427.1 and XM_005563370.2, UniProt ID: G7PBW5. Additional examples of CYP7A1 mRNA sequences are readily available using, e.g., GenBank, UniProt, OMIM, and the *Macaca* genome project web site. Exemplary CYP7A1 nucleotide and amino acid sequences may also be found in Table 1, SEQ ID NOs: 1-8.

The term "CYP7A1," as used herein, also refers to naturally occurring DNA sequence variations of the CYP7A1 gene. Numerous sequence variations within the CYP7A1 gene have been identified and may be found at, for example, NCBI dbSNP and UniProt (see, e.g., ncbi.nlm.nih.gov/snp).

Further information on CYP7A1 can be found, for example, at ncbi.nlm.nih.gov/gene/1581. The entire contents of each of the foregoing GenBank Accession numbers and the Gene database numbers are incorporated herein by reference as of the date of filing this application.

Table 1 below summarizes exemplary amino acid sequences of CYP7A1 proteins and DNA sequence of CYP7A1 genes of various mammals.

TABLE 1

Exemplary Amino Acid and DNA Sequences of CYP7A1

| | Sequence | SEQ ID NO |
|---|---|---|
| Human CYP7A1 Nucleic Acid (NM_000780.4) | AGTGGCATCCTTCCCTTTCTAATCAGAGATTTTCTTCCTCAGAGATTTTGGCCTAGATTT<br>GCAAAATGATGACCACATCTTTGATTTGGGGGATTGCTATAGCAGCATGCTGTTGTCTAT<br>GGCTTATTCTTGGAATTAGGAGAAGGCAAACGGGTGAACCACCTCTAGAGAATGGATTAA<br>TTCCATACCTGGGCTGTGCTCTGCAATTTGGTGCCAATCCTCTTGAGTTCCTCAGAGCAA<br>ATCAAAGGAAACATGGTCATGTTTTTACCTGCAAACTAATGGGAAAATATGTCCATTTCA<br>TCACAAATCCCTTGTCATACCATAAGGTGTTGTGCCACGGAAAATATTTTGATTGGAAAA<br>AATTTCACTTTGCTACTTCTGCGAAGGCATTTGGGCACAGAAGCATTGACCCGATGGATG<br>GAAATACCACTGAAAACATAAACGACACTTTCATCAAAACCCTGCAGGGCCATGCCTTGA<br>ATTCCCTCACGGAAAGCATGATGGAAAACCTCCAACGTATCATGAGACCTCCAGTCTCCT<br>CTAACTCAAAGACCGCTGCCTGGGTGACAGAAGGGATGTATTCTTTCTGCTACCGAGTGA<br>TGTTTGAAGCTGGGTATTTAACTATCTTTGGCAGAGATCTTACAAGGCGGGACACACAGA<br>AAGCACATATTCTAAACAATCTTGACAACTTCAAGCAATTCGACAAAGTCTTTCCAGCCC<br>TGGTAGCAGGCCTCCCCATTCACATGTTCAGGACTGCGCACAATGCCCGGGAGAAACTGG<br>CAGAGAGCTTGAGGCACGAGAACCTCCAAAAGAGGGAAAGCATCTCAGAACTGATCAGCC<br>TGCGCATGTTTCTCAATGACACTTTGTCCACCTTTGATGATCTGGAGAAGGCCAAGACAC<br>ACCTCGTGGTCCTCTGGGCATCGCAAGCAAACACCATTCCAGCGACTTTCTGGAGTTTAT<br>TTCAAATGATTAGGAACCCAGAAGCAATGAAAGCAGCTACTGAAGAAGTGAAAAGAACAT<br>TAGAGAATGCTGGTCAAAAAGTCAGCTTGGAAGGCAATCCTATTTGTTTGAGTCAAGCAG<br>AACTGAATGACCTGCCAGTATTAGATAGTATAATCAAGGAATCGCTGAGGCTTTCCAGTG<br>CCTCCCTCAACATCCGGACAGCTAAGGAGGATTTCACTTTGCACCTTGAGGACGGTTCCT<br>ACAACATCCGAAAAGATGACATCATAGCTCTTTACCCACAGTTAATGCACTTAGATCCAG<br>AAATCTACCCAGACCCTTTGACTTTTAAATATGATAGGTATCTTGATGAAAACGGGAAGA<br>CAAAGACTACCTTCTATTGTAATGGACTCAAGITAAAGTATTACTACATGCCCTTTGGAT<br>CGGGAGCTACAATATGTCCTGGAAGATTGTTCGCTATCCACGAAATCAAGCAATTTTTGA<br>TTCTGATGCTTTCTTATTTTGAATTGGAGCTTATAGAGGGCCAAGCTAAATGTCCACCTT<br>TGGACCAGTCCCGGGCAGGCTTGGGCATTTTGCCGCCATTGAATGATATTGAATTTAAAT<br>ATAAATTCAAGCATTTGTGAATACATGGCTGGAATAAGAGGACACTAGATGATATTACAG<br>GACTGCAGAACACCCTCACCACACAGTCCCTTTGGACAAATGCATTTAGTGGTGGTAGAA<br>ATGATTCACCAGGTCCAATGTTGTTCACCAGTGCTTGCTTGTGAATCTTAACATTTTGGT<br>GACAGTTTCCAGATGCTATCACAGACTCTGCTAGTGAAAAGAACTAGTTTCTAGGAGCAC<br>AATAATTTGTTTTCATTTGTATAAGTCCATGAATGTTCATATAGCCAGGGATTGAAGTTT<br>ATTATTTTCAAAGGAAAACACCTTTATTTTATTTTTTTTCAAAATGAAGATACACATTAC<br>AGCCAGGTGTGGTAGCAGGCACCTGTAGTCTTAGCTACTCGAGAGGCCAAAGAAGGAGGA<br>TGGCTTGAGCCCAGGAGTTCAAGACCAGCCTGGACAGCTTAGTGAGATCCCGTCTCCGAA<br>GAAAAGATATGTATTCTAATTGGCAGATTGTTTTTTCCTAAGGAAACTGCTTTATTTTTA<br>TAAAACTGCCTGACAATTATGAAAAAATGTTCAAATTCACGTTCTAGTGAAACTGCATTA<br>TTTGTTGACTAGATGGTGGGGTTCTTCGGGTGTGATCATATATCATAAAGGATATTTCAA<br>ATGATTATGATTAGTTATGTCTTTTAATAAAAAGGAAATATTTTTCAACTTCTTCTATAT<br>CCAAAATTCAGGGCTTTAAACATGATTATCTTGATTTCCCAAAAACACTAAAGGTGGTTT<br>TATTTTCCCTTCATGTTTTAACTTATTGTTGCTGAAAACTCTATGTCCGGCTTTAACTAT<br>CTTCTCTATATTTTTATTTCATTCACATTAATGAGAAGAGTTTTCTCAGAGATTAAAAAA<br>GGTAGTTTTTCTGTCATTGTTAAATACACATTATCACTGAAAAAATGTAGCTTTTATGTG<br>ATATGTTTTAAAGTTAAAACTGGATGGAAATAGCCATTTGGAAGCTTTGGTTATGAAACA<br>TGTGGAGTGTATTAAGTGCAGCTTGACATTATGTTTTATTTAAATGCTTTTTATCGCTAA<br>ATGACTTGCAGATGAAAAAAACTAAGGTGACTCGAGTGTTTAAATGCTGTGTACAACAAT<br>GCTTTGATAAAATATTTTAAGTATGAGTTATCAGCTCTATGTCAATTGATATTTCTGTGT<br>AGTATTTATATTTAAATTATATTTACCTTTTTGCTTATTTTACAAATATTAAGAAAATAT<br>TCTAACATTTGATAATTTTGAAATGATTCATCTTTCAGAAATAAAAGTATGAATCTA | 1 |
| Human CYP7A1 Protein (NP_000771.2) | MMTTSLIWGIAIAACCCLWLILGIRRRQTGEPPLENGLIPYLGCALQFGANPLEFLRANQ<br>RKHGHVFTCKLMGKYVHFITNPLSYHKVLCHGKYFDWKKFHFATSAKAFGHRSIDPMDGN<br>TTENINDTFIKTLQGHALNSLTESMMENLORIMRPPVSSNSKTAAWVTEGMYSFCYRVMF<br>EAGYLTIFGRDLTRRDTQKAHILNNLDNFKQFDKVFPALVAGLPIHMERTAHNAREKLAE<br>SLRHENLQKRESISELISLRMFLNDTLSTEDDLEKAKTHLVVLWASQANTIPATFWSLFQ<br>MIRNPEAMKAATEEVKRTLENAGQKVSLEGNPICLSQAELNDLPVLDSIIKESLRLSSAS<br>LNIRTAKEDFTLHLEDGSYNIRKDDIIALYPQLMHLDPEIYPDPLTFKYDRYLDENGKTK<br>TTFYCNGLKLKYYYMPFGSGATICPGRLFAIHEIKOFLILMLSYFELELIEGQAKCPPLD<br>QSRAGLGILPPLNDIEFKYKFKHL | 2 |
| Mouse CYP7A1 Nucleic Acid (NM_007824.3) | GGACCGTCTTGCTTTGCTAAGCACAGATTCTCCCCTTGGGACGTTTTCCTGCTTTTGCAA<br>AATGATGAGCATTTCTTTGATCTGGGGGATTGCTGTGGTAGTGAGCTGTTGCATATGGTT<br>TATCATTGGAATAAGGAGAAGGAAAGTAGGTGAACCTCCTTTGGACAACGGGTTGATTCC<br>ATACCTGGGCTGTGCTCTGAAGTTCGGATCCAATCCTCTTGAATTCCTAAGAGCAAAGCA<br>AAGGAAACATGGCCATGTTTTTACCTGCAAACTGATGGGGAAATATGTCCACTTCATCAC<br>AAACTCCCTGTCATACCACAAAGTCTTATGTCACGGAAAATATTTTGACTGGAAAAAATT<br>TCATTACACTACTTCTGCGAAGGCATTTGGACACAGAAGCATAGACCCAAGTGATGGAAA<br>TACCACGGAAAACATAAACAAGACTTTTAACAAAACCCTCCAGGGAGATGCTCTGTGTTC<br>ACTCTCTGAAGCCATGATGCAAAACCTCCAATCTGTCATGAGACCTCCGGGCCTTCCTAA<br>ATCAAAGAGCGCTGTCTGGGTCACGGAAGGGATGTATGCCTTCTGCTACCGAGTGATGTT<br>TGAAGCCGGATATCTAACGCTGTTTGGCAAAGATATTTCAAAGACAGACTCACAAAGAGC<br>ATTTATTCAAAACAACCTTGACAGCTTCAAACAATTTGACCAAGTATTTCCGGCACTAGT<br>GGCGGGCGTCCCTATTCACTTGTTCAAGACCGCACATAAAGCCCGGGAAAGGCTGGCTGA<br>GAGCTTGAAGCACAAGAACCTGTACATGAGGGACCAGGTCTCTGAACTGATCCGTCTACG<br>CATGTTTCTCAACGATACACTCTCCACCTTTGATGACATGGAGAAGGCTAAGACGCACCT | 3 |

TABLE 1-continued

Exemplary Amino Acid and DNA Sequences of CYP7A1

| | Sequence | SEQ ID NO |
|---|---|---|
| | CGTGATCCTCTGGGCATCTCAAGCAAACACCATTCCTGCAACCTTCTGGAGCTTATTTCA<br>AATGATCAGGAGCCCTGAAGCAATGAAAGCAGCCTCTGAAGAAGTGAATGGAGCATTACA<br>GAGTGCTGGCCAAGAGCTCAGCTCTGGAGGGAATGCCATTTACTTGGATCAAGAGCAACT<br>AAACAACCTGCCAGTACTAGATAGCATCATCAAGGAGGCTCTGCGGCTCTCCAGTGCATC<br>CTTGAATATCCGGACAGCTAAGGAGGACTTCACTCTACACCTTGAGGATGGTTCCTATAA<br>CATTCGAAAAGATGACATCATAGCTCTTTACCCACAGTTAATGCACTTGGATCCTGAAAT<br>CTACCCAGACCCTTTGACTTTTAAATACGACCGGTACCTTGATGAAAGTGGGAAAGCAAA<br>GACCACCTTCTATAGAAATGGAAACAAGCTGAAGTATTTCTACATGCCCTTTGGATCAGG<br>AGCTACAATATGTCCTGGAAGACTATTTGCTGTCCAAGAAATCAAGCAATTTTTGATTCT<br>GATGCTGTCTTACTTTGAACTGGAGCTTGTAGAGAGCCACACCAAGTGTCCCCCTCTAGA<br>TCAGTCCCGGGCAGGCTTGGGAATTTTGCCACCACTAAATGATATTGAGTTTAAATATAA<br>ACTGAAACACTGATATGTGGTTGGAAGAAGAGGACACTGGATGATGTAACGACTGCTGAG<br>CGTTATCAGTAAACAGGCCTTTGGGACTAGTGCTCACTGAAGCCCCCTAGTAGCTGTATT<br>AGTGAGAAGAACTCTGTTCTTACTGCTCACGTTCCTGGGGATTCGTGTAGCTGGGGCCTG<br>AGTTTCATCACTTTCAGAGCAACGTCTTTTGTTTTTATTTTCAAAATGAAGATATTCCAA<br>TTGGCAGGGTTCTTTCCTAAGGAAATTGCTTTATATTTTTATGAAAACTACCGATTAATT<br>ATGGAAGTACTTCAAATTCACGTTTTAGTGAAATTATTAATTTTTCACTAGTAAGGTTCT<br>TCATGTGTGAGTATATTATAAAAATGTTTAGCTGATCATATCATGCTTTGCATAAAGGG<br>AAAGGAAATTATTGTTCAGCTTTTTTTTTATGGTGGTGAGAGCTTGAAAATGATCTTACT<br>ATTCTAGAACTACTAGGGAAGTTTCGACATGCTCTCGCTATATTTTAATTTATTGTTGCT<br>GGAGATTTTTATTCCAGTTTTGAACTACTTTATCTTTCCTTCTTTTTGACACACATACCA<br>ATAAGAAGAGCATTTTTCAGAAATTATAAAGGCACCTCCAAGAACCACACCATGAGTCTT<br>TTAAGCCTTTAATTCCAGCTCCCATGAGGCAAAGCCAGGCAAATCTCTATGAGTCTGAGG<br>TTATTCTGGTCTACATCAGCTCTAGACAAGCCAGGACTACAGAAAGGACCTTGTCTAAAA<br>AGAAAAAAAGTTAATTTCTATGTCATATTTGATTATGAATCAACATGAAATATAAATTTA<br>AAATCAGGACTCAGAGAAATGATCAATTAAAAAACTTAGCTATGAAGTATGTGGAGTTCT<br>TTAAGTACAAGTTGACATTATATGTTCTTTTTTTATGGTTTGTTGTAGAAAGGCACGGAG<br>AAAGAAAGAAGGTAGAAAGAGAGAGACACCGGCCATGGCCACGTGGAGAGAGGGGGGAAG<br>GGAAAGAGAGAAGGAGGCCTAGAGAGTAAGAAAGGTGAGGGCTTAAAGAGCTATATGCTC<br>TTTAAAAATGTTTTATGTTTTTATCTCTAAATGCCTTAAAGATGAAGAACAATAATGAAA<br>GGCTGAGTAATAGTGTTTAAATACTGAGTGCAATAGTGCTTTAGTAATATACTTTAAAGA<br>GAGTTATTAGCTATGTCATTTTTACTGAAAATATATTTATATATAAATTATATTTATCTT<br>TTTCTTATACCATATATATATAAAAATATTGTAACATTTAGTAATTTTAAAATTACACACCT<br>TTCAGAAATTAACATATGAATGTTCGTGTTTTAAACTTTGAACAGAACATTTAAATTATT<br>CATCTACTGGTAAGCTACAATAATTTTTCTCATATTTATTTAAAATATTCATATTTTCAA<br>GAAATCCAAAAATATCCAAAGTAATCACTCAGTCAAATAGATCCCTAAGATGACAGTAAA<br>TTCAATACCATGCTTTTGTCTGCGAGGGCTGGAGCAGGGTCCAGTGGATGCTGTGCAGGT<br>CCTCCAGCAGAGAGCTAAATCCACAGACTCCTCAAAATCTTAAAACCTTACCACTGAATA<br>CTGGCACAGAGTTATTACCTAGGTACGCTATGCTTCCTTCCTTTTTCATTTTGACAGAGG<br>CCCATAGCATCCCAGGCTGGAACATTCCGCGTAGCTTAAGCAAGCTTGGAACTCACTGTG<br>CTTCCTGCTTTGCCTTGTTATAGGAAGTAATTTTCAAGACCAAGAAAACTTAATTGTTTA<br>GATGAGCTATAAGAAAGACACAATTGTGTTGTATACTAATCTGTACTAAGCTAAATTTGT<br>TTTTAAAACAAGTTTTATGACTCCCTGAACTGAATGTATCCACATACCTTCCCATGGCTT<br>TTTAAAAGCATATTTTTCATACAGAATGATGGGTCTCCTGGTGGTGCCTTCTTCTCATAT<br>TTTTATTCTTGTGAAGTGATGGCTAGCAAACAATAGCCTGTCAACCAAAGTTACTCTTCC<br>CGTTTCTGTGCAGCCTAAGTGTTAAAAGTAATTTTTACATTTTTAAATGCTTAGGGGAAA<br>AAAACCACATGTCTATTTTGTGTCATATACGAAGTATATGAAATACAGACTAGCAAACCC<br>GTGACTAAAACTTTTATTGGGATATCAGAATCTGCCTAATTCTTTGCGTTATGTCTACAA<br>TTCCATTTTTTGACATGTGTATGTAGTGTGCATTTTTGTGGAAGCATGTGTGAGTGTGTG<br>TGCACATGTGGGTAAACATGTGTGCATGTGTGTAGAGGCTGGAGGTGATGTTGAGTGTTT<br>TCCTCCACTGTTCTCCCTTGAGGGTCTCTCCCTTGAGCCAGAGTCCAATGCTTAGGCTAG<br>CATAGCCAACTTGCCGCAGTGCCCTTGAATTGCAGGAGGTTGCCACATCCTCCTGGCATT<br>TACCCTGGTGTGAGATGAGCTTCAGAAGGGCAAGTGCTTTGTCTGCTAGTCTCAGTGTCT<br>ACAGCTCTTGCTGTGTAATTGTAAAGGCAGGGTAGTGTGACATAGACAGGAGGACACAGA<br>GCTTACCATTTCAAAAATCAGTTTCTTCAGAGT | |
| Mouse<br>CYP7A1<br>Protein<br>(NP_031850.2) | MMSISLIWGIAVVVSCCIWFIIGIRRRKVGEPPLDNGLIPYLGCALKFGSNPLEFLRAKQ<br>RKHGHVFTCKLMGKYVHFITNSLSYHKVLCHGKYFDWKKFHYTTSAKAFGHRSIDPSDGN<br>TTENINKTENKTLCGDALCSLSEAMMCNLQSVMRPPGLPKSKSAVWVTEGMYAFCYRVMF<br>EAGYLTLFGKDISKTDSQRAFIQNNLDSFKQFDQVFPALVAGVPIHLFKTAHKARERLAE<br>SLKHKNLYMRDQVSELIRLRMFLNDTLSTFDDMEKAKTHLVILWASQANTIPATFWSLFQ<br>MIRSPEAMKAASEEVNGALQSAGQELSSGGNAIYLDQEQLNNLPVLDSIIKEALRLSSAS<br>LNIRTAKEDFTLHLEDGSYNIRKDDIIALYPQLMHLDPEIYPDPLTFKYDRYLDESGKAK<br>TTFYRNGNKLKYFYMPFGSGATICPGRLFAVQEIKCFLILMLSYFELELVESHTKCPPLD<br>QSRAGLGILPPLNDIEFKYKLKH | 4 |
| Rat<br>CYP7A1<br>Nucleic<br>Acid<br>(NM_012942.2) | GTCTCCCCTTTGGAAATTTTCCTGCTTTTGCAAAATGATGACTATTTCTTTGATTTGGGG<br>AATTGCCGTGTTGGTGAGCTGTTGCATATGGTTTATTGTTGGAATAAGGAGAAGGAAAGC<br>TGGTGAACCTCCTTTGGAGAACGGGTTGATTCCGTACCTGGGCTGTGCTCTGAAATTTGG<br>ATCTAATCCTCTTGAGTTCCTAAGAGCTAATCAAAGGAAGCATGGTCACGTTTTTACCTG<br>CAAACTGATGGGGAAATATGTCCATTTCATCACAAACTCCCTGTCATACCACAAAGTCTT<br>ATGTCATGGAAAATATTTTGACTGGAAAAAATTTCATTACACTACTTCTGCGAAGGCATT<br>TGGACACAGAAGCATTGACCCAAATGATGGAAATACCACGGAAAATATAAACAACACTTT<br>TACCAAAACCCTCCAGGGAGATGCTCTGTGTTCACTTTCTGAAGCCATGATGCAAAACCT | 5 |

TABLE 1-continued

Exemplary Amino Acid and DNA Sequences of CYP7A1

| | Sequence | SEQ ID NO |
|---|---|---|
| | CCAATCTGTCATGAGACCTCCTGGCCTTCCTAAATCAAAGAGCAATGCCTGGGTCACGGA<br>AGGGATGTATGCCTTCTGTTACCGAGTGATGTTTGAAGCTGGCTATCTAACACTGTTTGG<br>CAGAGATATTTCAAAGACAGACACACAAAAAGCACTTATTCTAAACAACCTTGACAACTT<br>CAAACAATTTGACCAAGTCTTTCCGGCACTGGTGGCAGGCCTTCCTATTCACTTGTTCAA<br>GACCGCACATAAAGCTCGGGAAAAGCTGGCTGAGGGATTGAAGCACAAGAACCTGTGTGT<br>GAGGGACCAGGTCTCTGAACTGATCCGTCTACGTATGTTTCTCAATGACACGCTCTCCAC<br>CTTTGACGACATGGAGAAGGCCAAGACGCACCTCGCTATTCTCTGGGCATCTCAAGCAAA<br>CACCATTCCTGCAACCTTTTGGAGCTTATTTCAAATGATCAGGAGTCCTGAAGCAATGAA<br>AGCAGCCTCTGAAGAAGTGAGTGGAGCTTTACAGAGTGCTGGCCAAGAGCTCAGCTCTGG<br>AGGGAGTGCCATTTACTTGGATCAAGTGCAACTGAATGACCTGCCGGTACTAGACAGCAT<br>CATCAAGGAGGCTCTGAGGCTTTCCAGTGCATCCTTGAATATCCGCACAGCTAAGGAGGA<br>CTTCACTCTCCATCTTGAGGACGGTTCCTATAACATCCGAAAAGATGACATGATAGCTCT<br>TTATCCACAGTTAATGCACTTGGATCCTGAAATCTACCCAGACCCTTTGACTTTCAAATA<br>TGACCGGTACCTTGATGAAAGCGGGAAAGCAAAGACCACCTTCTACAGTAATGGAAACAA<br>GCTGAAGTGTTTCTACATGCCCTTCGGATCAGGCGCGACAATATGTCCTGGAAGACTCTT<br>TGCCGTCCAAGAAATCAAGCAGTTTTTGATCCTGATGCTCTCCTGCTTTGAACTGGAGTT<br>TGTGGAGAGCCAAGTCAAGTGTCCCCCTCTAGACCAGTCCCGGGCAGGCTTGGGAATTTT<br>GCCACCACTACATGATATTGAGTTTAAATATAAACTGAAACACTGATACGTGGTTGGAAG<br>AAGCGAACACTGGATGATGTCACTTGGCGGCTGAGAGTCATCACTAAACAGGCCTTCGGG<br>ACCAATGCTCACTGATGCGCCCTAGCGACTGGATTAGTGGGAAGAACTTTGTTCTCGCTG<br>CCCACATTCCTGGGTGTTCACATAGCTGGGGCCAGAGCTTCATCACTTTCAGAAAGCAAT<br>GTCTTTTGTATTTATTTTCAAAATGAAGATATTCCAATTGGCAGGATATTTTTCCTAAGG<br>AAATTGCTTTATATTTTTATGAAAACTACCAATTAATTATGAAAGGGCTTGAAATTCACG<br>TTTTAGTGAAATTACTGATTTTTCACTAGTAAGGTTCTTCAGGTGTGAAACTGTATTATA<br>AAAATGTTGTAATGGGTCACACTGTGCTTTGCATAAAGGTAAAGGAAACTATGTTTCAGC<br>CTTTTCTGTGTCTATGAGCTTCGAAAATAATCTTACTGTTCTAGAAACACTGGGGAGGTT<br>TCGACATGCTCTCGCTATATTTTATTTTACTGTTGCTAGAAATTTTCATTCCAGTTTTCA<br>ACTACCTTATCTTTCCCCCATTTTGACATGCATGCCAATGAGAAGAGTATTTTTTAGGAA<br>TTAACAAGGCACCTCCCAGAACCCTACCCTGAGACTTTTAAGCCTTTAATCCCAGCACTC<br>GAGAAGTAGAGCCAGGCAGATCTCTGAGTCTGAGGTTATTCTGGTCTACATCAGCTCCAG<br>ACAAGCCAGGACTACAGAATGGGATCTTGTCTAAAAAATACAGCTAATCTTTATGTCATA<br>ACTGATTATGAATCAACCTAAAAGATAAATTTTCAATCAGGACTCAGAGAAAATGAGCAA<br>TTAAAAAACTTAGCTCTGAGGTATGTGGAATTCATTAAGTACAAGTTGACATTACATGTT<br>CTTTAAAAATAGTTTATGTTTTATCTCTAAATGCCCTGCAGATGAAGAATAATAATGAAA<br>AGTTGAATAATACTGTTTAAACACTAAGTGCAATAATGCTTTGGTAATGTACTTTAAGAG<br>AATCATTAGCCGTGCCAGTTTTACTAAAATATATTTATATGTAAATTATATTTATCTTTT<br>TCTTATACCATAAATATAAAAATATTGCAACATTTAGTAATTTTAAAATTATATACCTTT<br>CAGAAAATGATGTATGAATGTTTGTATGTTTTTTAACTTTGAACAGAACATTTAAATTAT<br>TCATCTACGGTGATTTTTATCTTATTTATTTCTTTTTGTCTCATTCATATCTTGAAGAAA<br>TCCAAAAATATCTGAAGGAATCGCTCACTCAAATGTCTCCCTATGGTTACAGAAAAATTC<br>AATACCATGTTTTTGTCCTCGGGGACTGAAGCAGGGTGTCGTGGGTGCCGAGCAGAGGCT<br>CCTGCTGCAGCGAGCTTTATCCACGGGACTCCTTAAACTTTTAAAATCTTATCACTATTA<br>TCATGCATTTATTACCTAAGTAGGATATTTCCCTTTCCTTTTTCATTTCAGCCGAGTCCC<br>TTAGCAACCCAGGCTGACTGGGACCCTCCATGTAGCTTAAGCTGTGAACTCACTGTACTT<br>CCTGTTTTCACTTATTTTAGGAAGTAATTTTCCCTATCAGAAATTTTAATTGTTTAGATG<br>ATGTATAAGAGTAACACAATTCTGTTATATACTAATCTGTAGTAAACTAAATTTGTTCTT<br>AGAACAAGTTTGATGACTCTCAAATTGAATGTATCCATACATCTTTCCATGGCTTCTTGA<br>ATGCCCATTTCTCATACACAGAATGATGGGTTTCACGGTGATGTCTTCCTTTCATGTCTT<br>TATTCTTGTGCGGTGATGGTTGGCAAATGATACCCATGGAGCAAGGTTACTCTTCCTATT<br>TCTGTGCAGCCTAAGTGTTAAGAATAATTTTTAAATACTTGGAGGGAAGGCACATTTTGT<br>GTCATATGTGAAGTGACATGTGACACACAGACTAGCAAATCCTTGAGTAAAATTTTATTG<br>GGAT | |
| Rat CYP7A1 Protein (NP_037074.1) | MMTISLIWGIAVLVSCCIWFIVGIRRRKAGEPPLENGLIPYLGCALKFGSNPLEFLRANQ<br>RKHGHVFTCKLMGKYVHFITNSLSYHKVLCHGKYFDWKKFHYTTSAKAFGHRSIDPNDGN<br>TTENINNTFTKTLQGDALCSLSEAMMCNLQSVMRPPGLPKSKSNAWVTEGMYAFCYRVMF<br>EAGYLTLFGRDISKTDTQKALILNNLDNFKQFDQVFPALVAGLPIHLFKTAHKAREKLAE<br>GLKHKNLCVRDQVSELIRLRMFLNDTLSTFDDMEKAKTHLAILWASQANTIPATFWSLFQ<br>MIRSPEAMKAASEEVSGALQSAGQELSSGGSAIYLDQVQLNDLPVLDSIIKEALRLSSAS<br>LNIRTAKEDFTLHLEDGSYNIRKDDMIALYPQLMHLDPEIYPDPLTFKYDRYLDESGKAK<br>TTFYSNGNKLKCFYMPFGSGATICPGRLFAVQEIKCFLILMLSCFELEFVESQVKCPPLD<br>QSRAGLGILPPLHDIEFKYKLKH | 6 |
| Cyno CYP7A1 Nucleic Acid (XM_ 005563370.2) | GTCAACAAGCTCAAGTTAATGGATCTGGGTACTATGTATATAAAAAAACCTAGCTTGAGT<br>CTCTTTTCAGTGACATCTTTGCCTTTCTAATCAGAGATTTTCTTCCTCAGAGATTTTGGC<br>CTAGATTTGCAAAATGATGACCATATCTTTGATTTGGGGGATTGCTATAGCAGCATGCTG<br>TTGTCTATGGCTTATTCTTGGAATAAGGAGAAGGCAAACGGGTGAACCACCTCTAGAGAA<br>TGGGTTGATTCCATACCTGGGCTGTGCGCTGCAATTTGGTGCCAATCCTCTTGAGTTCCT<br>CAGAGCAAATCAAAGGAAACATGGTCATGTTTTTACCTGCAAACTAATGGGAAAATATGT<br>CCATTTCATCACAAATCCCTTGTCATACCATAAGGTGTTGTGCCATGGAAAATACTTTGA<br>TTGGAAAAAAATTTCACTTTGCTACTTCTGCAAAGGCTTTTGGGCACAGAAGCATTGACCC<br>AAAGGATGGAAATACCACTGAAAACATAAACAACACTTTCATCAAAACCCTGCAGGGCAA<br>TGCCTTGAATTCCCTCACGGAAAGCATGATGGAAAACCTCCAACGTATCATGAGACCTCC<br>AGTCTTCTCTAACTCAAAGACCGCTGCCTGGGTGACAGAAGGGATGTATTCCTTCTGCTA | 7 |

TABLE 1-continued

Exemplary Amino Acid and DNA Sequences of CYP7A1

| | Sequence | SEQ ID NO |
|---|---|---|
| | CCGAGTGATGTTTGAAGCTGGGTATTTAACTATCTTTGGCAGGGATCTTACAAGGCAAGA<br>CACACAGAAAGCACATATTCTAAACAATCTTGACAACTTCAAGCAGTTCGACAAAGTCTT<br>TCCAGCCCTGGTAGCAGGCCTCCCCATTCACATGTTCAGGACCGCGCACAGTGCCCGGGA<br>GAAACTGGCAGAGAGCTTGAGGCACGAGAACCTCCAAAAGAGGGAAAGCGTCTCAGAACT<br>GATCAGACTGCGCATGTTTCTCAATGACACTTTGTCCACCTTTGATGACCTGGAGAAGGC<br>CAAGACGCACCTCGTGGTCCTCTGGGCATCGCAAGCAAACACCATTCCAGCAACTTTCTG<br>GAGTTTATTTCAAATGATTAGGAACCCGGAAGCAATGAAAGCAGCTACTGAAGAAGTGAA<br>AAGAACATTAGAGAATGCTGGTCAAAAAGTCAGCTTGGAAGGCAATCCCATTTGTTTGAG<br>TCAAACACAACTGAATGACCTGCCAGTATTAGAAAGCATAATCAAGGAATCACTGAGGCT<br>TTCCAGTGCCTCCCTCAACATTCGGACAGCTAAGGAGGATTTCACTTTGCACCTTGAGGA<br>CGGTTCCTACAACATCCGAAAAGATGACATCATAGCTCTTTACCCACAGTTAATGCACTT<br>AGATCCAGAAATCTACCCAGACCCTTTGATTTTTAAATATGATAGGTATCTTGATGAAAA<br>CGGGAAGACAAAGACTACCTTCTACTGTAATGGACTCAAATTAAAGTATTACTACATGCC<br>CTTTGGATCAGGAGCTACAATATGCCCTGGAAGAGTGTTTGCTATCCACGAAATCAAGCA<br>ATTTTTGGTTTTGATGCTTTCTTATTTTGAACTGGAGCTTGTCGAGGGCCAAGATAAATG<br>TCCGCCTTTGGACCAGTCCCGGGCAGGCTTGGGCATTTTGCCGCCATTATATGACATTGA<br>GTTTAAATATAAATTCAAGCATTTGTGAATACGTGGCTGAAATAAGAGGACACTAGATGA<br>TATTACAGGACTGCAGAACACCATCACCACACAGTCCCTTTGGATAAATGCATTTAGTGG<br>TGGTAGAAATGATTCACCAGGTCCAATGTTGTTCACCAATGCTTGCTTGTGAATCTTAAT<br>ATTTTGGTGACAGTTTCCAGATGGTGTCGCAGACTGTGCTAGTGAAAAGAACTAGTTTCT<br>AGGAGCACGATAATTTGTTTTCATCTGTATGAGTCCATGAATGTTCATATAGCCAGGGGT<br>TGAAGTTTATTTTTTTCAGAGGAAAACACCTTTTTTTTTTTCCCCCCCCCAAAATGAAG<br>ATACACATTCCAGCCAGGTATTGTAGCAGGCACCTGTAGTCTTAGCTACTCGAGAGGCCA<br>AAGAAGGAGGATGGCTTGAGCCCAGGAGTTCAAGACTAGCCTGGACAGCTTAGTGAGACC<br>CCGTCTCTAAAGAAAAGATACGTATTCTAATTGGCAGATTGTTTTTTCCTAAGGAAACTG<br>CTTTATTTTTATAAAACTGCCCAACAATTATGAAACATGTTCAAATTCACGTTCTAGTGA<br>AACTGCATTATTTTTTTACTAGATGTTGGGGTTCTTCAGGTGTGATCATATATCATAAAG<br>GATATTTCAAATGATTATGATTAGTTATGTCTTTTAATAAAAAGGAAATACTTTTCAACT<br>TTTTATATATCCAAAATTCAGGGCTTTAAAAATGATTATTTTGATTTCCCAAAAACACTA<br>AAGGTGGTTTTAATATTTTCCCTTTATGTTTTAACTTATTGTTGCTGAAAACTCTATGTC<br>CAGCTTTAACTATCTTCTCTGTATTTTTATTTCATTTCATATTAATGAGAAGAGTTTTTT<br>TCAGAGATTAAAAAAGGCAGTTTTTCTGTTATTGTTAAATACACACTATCACTGAACAAA<br>TGTAGCTTTTATGTGATCTGTTTTAAAGTTAAAACCGGATGGAAATAGCCGTTTGAAAGC<br>TTTGGTTATGAAACATGCGGAGTGTATTAAGTACGGCTTGACATTATGTTTTATTTAAAT<br>GCTTTTTATCGCTAAATGACTTGCAGATGAAAAAAAACTAAGGTGGCCTGAGAGTTTAAA<br>TGCTGTGTACAACAATGCTTTGATAATATATTTTAAGTATGAGTTAT<br>CAGCTATATGTCAATTGATATTTCTGTGCAGTATTTATATGTAAATTATATTTACCTTTT<br>TGCTTATTTTATAAATATTAAGAAAGTATTCTAACATTTCATAATTTTGAAATGATTCAT<br>CTTTCAGAAATAAAAGTATGAATCTA | |
| Cyno CYP7A1 Protein (XP_ 005563427.1) | MMTISLIWGIAIAACCCLWLILGIRRRQTGEPPLENGLIPYLGCALQFGANPLEFLRANQ<br>RKHGHVFTCKLMGKYVHFITNPLSYHKVLCHGKYFDWKKFHFATSAKAFGHRSIDPKDGN<br>TTENINNTFIKTLQGNALNSLTESMMENLCRIMRPPVFSNSKTAAWVTEGMYSFCYRVMF<br>EAGYLTIFGRDLTRQDTQKAHILNNLDNFKQFDKVFPALVAGLPIHMERTAHSAREKLAE<br>SLRHENLQKRESVSELIRLRMFLNDTLSTFDDLEKAKTHLVVLWASQANTIPATFWSLFQ<br>MIRNPEAMKAATEEVKRTLENAGQKVSLEGNPICLSQTQLNDLPVLESIIKESLRLSSAS<br>LNIRTAKEDFTLHLEDGSYNIRKDDIIALYPQLMHLDPEIYPDPLIFKYDRYLDENGKTK<br>TTFYCNGLKLKYYYMPFGSGATICPGRVFAIHEIKCFLVLMLSYFELELVEGQDKCPPLD<br>QSRAGLGILPPLYDIEFKYKFKHL | 8 |

As used herein, the term "CYP7A1 disease" or "CYP7A1-associated disease," is a disease or disorder that is caused by, or associated with, CYP7A1 expression and/or activity. The term "CYP7A1-associated disease" includes a disease, disorder or condition that would benefit from a decrease in CYP7A1 gene expression, replication, or protein activity. In some embodiments, a subject having a CYP7A1 disease or a CYP7A1-associated disease may benefit from the reduction in expression of CYP7A1 gene. In some embodiments, a CYP7A1 disease or CYP7A1-associated disease is a disease that is characterized by accumulation of toxic bile acids. A CYP7A1 disease or CYP7A1-associated disease may be a liver disease. In some embodiments, a CYP7A1-associated disease is a cholestatic liver disease. Cholestasis is resulted from disrupted bile flow from the liver to the intestine tract, leading to accumulation of toxic bile acids and other metabolites in the liver, decreased bile acids in the intestine and increased bile acids in the systemic circulation. The accumulation of toxic bile acids in the hepatobiliary system damages bile duct epithelial cells and hepatocytes, causing liver injury and inflammation. Chronic cholestasis leads to fibrosis, cirrhosis and eventually liver failure or hepatocellular or cholangiocellular carcinomas. Non-limiting examples of CYP7A1-associated diseases include, for example, cholestatic liver diseases such as primary sclerosing cholangitis (PSC), familial intrahepatic cholestasis (PFIC, including Type 1, PFIC1, Type 2, PFIC2, and Type 3, PFIC3) and primary biliary cholangitis (PBC), Alagille syndrome, biliary atresia, and other liver diseases such as nonalcoholic steatohepatitis (NASH), nonalcoholic fatty liver disease (NAFLD), and alcoholic liver disease (ALD).

Further details regarding signs and symptoms of the various diseases or conditions are provided herein and are well known in the art.

Compositions

CYP7A1 RNAi Agents

Some aspects of the present disclosure provide RNAi agents that target CYP7A1 (referred to herein as "CYP7A1 RNAi agent") In some embodiments, a CYP7A1 RNAi agent disclosed herein targets a CYP7A1 sequence (e.g., gene sequence, pre-mRNA sequence, or mRNA sequence). In some embodiments, a CYP7A1 RNAi agent disclosed herein is a double stranded siRNA comprising a sense strand and an antisense strand. In some embodiments, the antisense strand of a CYP7A1 RNAi agent disclosed herein comprises a region of complementary to a CYP7A1 RNA (e.g., pre-mRNA or mRNA) sequence. In some embodiments, a CYP7A1 RNAi agent disclosed herein are useful for reducing levels of CYP7A1 RNA and/or protein.

In some embodiments, a CYP7A1 RNAi agent disclosed herein target a CYP7A1 sequence at or near a position corresponding to a position provided in Table 2. In some embodiments, a CYP7A1 RNAi agent disclosed herein is a siRNA oligonucleotide comprising an antisense strand comprising a region of complementary to a CYP7A1 sequence at or near a position in a CYP7A1 sequence corresponding to a position provided in Table 2. "Near" a position, as used herein, means within 10 (e.g., 10, 9, 8, 7, 6, 5, 4, 3, 2, or 1) nucleosides upstream (5' end) or downstream (3' end) of the position.

As used herein, the "position" of a target sequence is represented by the "position" of the first nucleoside of the target sequence in a reference sequence. For example, for the CYP7A1 target sequences provided in Table 2, the reference sequence used is human CYP7A1 mRNA transcript and its corresponding cDNA sequence as set forth in NM_000780.4 (the reference sequence). The "position" for each target sequence provided in Table 2 refers to the position of the first nucleoside of a target sequence in SEQ ID NO: 1 (NM_000780.4). For example, the first C of the target sequence as set forth in SEQ ID NO: 9 is the $34^{th}$ nucleoside of SEQ ID NO: 1 (NM_000780.4). For the purposes of the present disclosure, when referring to RNAi agents that target a CYP7A1 sequence at or near a position (e.g., position 34), such RNAi agents encompasses RNAi agents that target a CYP7A1 sequence at or near the position in the reference sequence (SEQ ID NO: 1; NM_000780.4), and RNAi agents that target at or near a position in another CYP7A1 sequence (e.g., gene sequence, pre-mRNA sequence, or a variant or a homologue of human CYP7A1 mRNA, e.g., a splicing variant or a mRNA from a closely related species, such as a cynomolgus monkey) that corresponds to the position in the reference sequence. To identify a position in another CYP7A1 sequence that corresponds to a certain position in the reference sequence (SEQ ID NO: 1; NM_000780.4), such other CYP7A1 sequences can be aligned to the reference sequence and the position of a nucleoside corresponding the nucleoside in the reference sequence (SEQ ID NO: 1; NM_000780.4) can be determined. For example, the nucleosides at positions 34-52 of SEQ ID NO: 1 (NM_000780.4; upper sequence) are aligned to the nucleosides at positions 102-120 of the cynomolgus CYP7A1 sequence SEQ ID NO: 7 (XM_005563370.2; lower sequence) as follows:

```
CTTCCTCAGAGATTTTGGC
|||||||||||||||||||
CTTCCTCAGAGATTTTGGC
```

In the example above, when referring to RNAi agents that target a CYP7A1 sequence at or near position 34, the present disclosure encompasses RNAi agents that target at or near position 34 of NM_000780.4 (SEQ ID NO: 1) and RNAi agents that target at or near position 102 of XM_005563370.2 (SEQ ID NO: 7). In the present disclosure, unless otherwise indicated, the position of a nucleoside on another sequence is designated as the position of the corresponding nucleoside on the reference sequence. For example, in the exemplary alignment above, the first "C" of XM_005563370.2 (SEQ ID NO: 7) is designated as position 34 although it is the 102th nucleoside in XM_005563370.2 (SEQ ID NO: 7). In determining the position of a nucleoside of another sequence in relation to a reference sequence, the other sequence and the reference sequence are optimally aligned over the window of comparison, which comprises sufficient number of nucleosides for the alignment. Optimal alignment of sequences for aligning a comparison window may be conducted by computerized implementations of algorithms (GAP, BESTFIT, FASTA, and TFASTA in the Wisconsin Genetics Software Package Release 7:0, Genetics Computer Group, 575 Science Drive Madison, Wis., USA) or by inspection and the best alignment (i.e., resulting in the highest percentage homology over the comparison window) generated by any of the various methods selected. Reference also may be made to the BLAST family of programs as for example disclosed by Altschul et al., Nucl. Acids Res. 25:3389, 1997.

One or more insertions in another CYP7A1 sequence (e.g., gene sequence, pre-mRNA sequence, or a variant or a homologue of human CYP7A1 mRNA, e.g., a splicing variant or a mRNA from a closely related species, such as a cynomolgus monkey) relative to the reference sequence (SEQ ID NO: 1; NM_000780.4) are represented as position "N-M," wherein N represents the corresponding position immediately before the insertions in the reference sequence, and M represents the position of the nucleoside within the one or more insertions. For example, in the following alignment between positions 2336-2349 of the sequence set forth in SEQ ID NO: 1 (NM_000780.4; upper sequence) and positions 2406-2422 of the sequence set forth in SEQ ID NO: 7 (XM_005563370.2; lower sequence),

```
GGTTT---TATTTTCCC
|||||   |||||||||
GGTTTTAATATTTTCCC
```

The insertions TAA in SEQ ID NO: 7 (XM_005563370.2) follows the position 2340 (bolded T in the alignment above) in SEQ ID NO: 1 (NM_000780.4). Accordingly, the positions of insertions TAA are designated as 2340-1, 2340-2, and 2340-3, respectively.

One or more deletions or mismatches in another CYP7A1 sequence (e.g., gene sequence, pre-mRNA sequence, or a variant or a homologue of human CYP7A1 mRNA, e.g., a splicing variant or a mRNA from a closely related species, such as a cynomolgus monkey) relative to the reference sequence (SEQ ID NO: 1; NM_000780.4) may result in the lack of a "corresponding position." In these instances, as long as the deletions/mismatches (e.g., no more than 5, 4, 3, 2, 1 mismatches) are within a stretch of sequences of sufficient length (e.g., at least 20, 25, 30, 35, or 40 nucleosides) that aligned between the two sequences, the mismatched positions are represented as the position in the reference sequence that directly aligned even if the nucleoside in the reference is different. The position for the deletion in the other sequence is "skipped."

For example, the first 13 nucleosides (positions 1-13) of the SEQ ID NO: 1 (NM_000780.4; upper sequence) are aligned to the nucleosides at positions 69-82 of the cynomolgus CYP7A1 sequence SEQ ID NO: 7 (XM_005563370.2; lower sequence) as follows:

```
AGTGGCATCCTTC
|||| |||| ||.
AGTGACATCTTTG
```

The bolded G at position 5 of SEQ ID NO: 1 (NM_000780.4) aligns with the bolded A at position 73 of SEQ ID NO: 7 (XM_005563370.2). When referring to RNAi agents that target a CYP7A1 sequence at or near position 5, the present disclosure encompasses RNAi agents that target at or near position 5 of NM_000780.4 (SEQ ID NO: 1) and RNAi agents that target at or near position 73 of XM_005563370.2 (SEQ ID NO: 7).

In some embodiments, the antisense strand of a CYP7A1 RNAi agent disclosed herein comprises a core stretch of sequence that is fully, substantially, or at least partially complementary to a CYP7A1 target sequence disclosed in Table 2. CYP7A1 target sequences disclosed in Table 2 are 19 nucleosides in length. The core stretch of sequence that is fully, substantially, or at least partially complementary to a CYP7A1 target sequence disclosed in Table 2 may be, for example, 8, 9, 10, 11, 12, 13, 14, 15, 16, 17, 18, 19, 20 or 21 nucleosides in length.

In some embodiments, a CYP7A1 RNAi agent disclosed herein comprises a sense strand and an antisense strand, wherein the antisense strand comprises a region of complementary of 8-30 (e.g., 8-30, 8-25, 8-20, 8-15, 8-10, 10-30, 10-25, 10-20, 10-15, 15-30, 15-25, 15-20, 20-30, 20-25, or 25-30) nucleosides in length to a CYP7A1 sequence as set forth in any one of SEQ ID NOs: 1, 3, 5, and 7 (e.g., SEQ ID NO: 1). In some embodiments, a CYP7A1 RNAi agent disclosed herein comprises a sense strand and an antisense strand, wherein the antisense strand comprises a region of complementary of 8, 9, 10, 11, 12, 13, 14, 15, 16, 17, 18, 19, 20, 21, 22, 23, 24, 25, 26, 27, 28, 29, or 30 nucleosides in length to a CYP7A1 sequence as set forth in any one of SEQ ID NOs: 1, 3, 5, and 7 (e.g., SEQ ID NO: 1). In some embodiments, a CYP7A1 RNAi agent disclosed herein comprises a sense strand and an antisense strand, wherein the antisense strand comprises a region of complementary of at least 15 (e.g., 15, 16, 17, 18, 19, 20, or 21) nucleosides in length to a CYP7A1 target sequence as set forth in any one of SEQ ID NOs: 1, 3, 5, and 7 (e.g., SEQ ID NO: 1).

In some embodiments, a CYP7A1 RNAi agent disclosed herein comprises a sense strand and an antisense strand, wherein the antisense strand comprises a region of complementary of 8-21 (e.g., 8-21, 8-15, 8-10, 10-21, 10-15, 15-21, or 19-21) nucleosides in length to a CYP7A1 target sequence of nucleotides 113-133, 221-241, 249-269, 290-321, 475496, 504-524, 593-620, 671-691, 779-799, 839-862, 1003-1029, 1037-1057, 1082-1102, 1189-1209, 1207-1235, 1225-1246, 1235-1255, 1289-1316, 1384-1404, 1415-1435, 1431-1451, or 1559-1579 of SEQ ID NO: 1.

In some embodiments, a CYP7A1 RNAi agent disclosed herein comprises a sense strand and an antisense strand, wherein the antisense strand comprises a region of complementary of 8-21 (e.g., 8-21, 8-15, 8-10, 10-21, 10-15, 15-21, or 19-21) nucleosides in length to a CYP7A1 target sequence of nucleotides 113-133, 221-241, 249-269, 290-310, 301-321, 475-495, 476-496, 504-524, 593-613, 600-620, 671-691, 779-799, 839-859, 842-862, 1003-1023, 1009-1029, 1937-1057, 1082-1102, 1189-1209, 1207-1227, 1215-1235, 1225-1245, 1226-1246, 1235-1255, 1289-1309, 1296-1316, 1384-1404, 1415-1435, 1431-1451, or 1559-1579 of SEQ ID NO: 1.

In some embodiments, a CYP7A1 RNAi agent disclosed herein comprises a sense strand and an antisense strand, wherein the antisense strand comprises a region of complementary of 8-21 (e.g., 8-21, 8-15, 8-10, 10-21, 10-15, 15-21, or 19-21) nucleosides in length to a CYP7A1 target sequence of nucleotides 113-133, 475-495, 1226-1246, or 1235-1255 of SEQ ID NO: 1.

In some embodiments, a CYP7A1 RNAi agent disclosed herein comprises a sense strand and an antisense strand, wherein the antisense strand comprises a region of complementary of 8-21 (e.g., 8-21, 8-15, 8-10, 10-21, 10-15, 15-21, or 19-21) nucleosides in length to a CYP7A1 target sequence of nucleotides 113-133 of SEQ ID NO: 1.

In some embodiments, a CYP7A1 RNAi agent disclosed herein comprises a sense strand and an antisense strand, wherein the antisense strand comprises a region of complementary of 8-21 (e.g., 8-21, 8-15, 8-10, 10-21, 10-15, 15-21, or 19-21) nucleosides in length to a CYP7A1 target sequence of nucleotides 475-495 of SEQ ID NO: 1.

In some embodiments, a CYP7A1 RNAi agent disclosed herein comprises a sense strand and an antisense strand, wherein the antisense strand comprises a region of complementary of 8-21 (e.g., 8-21, 8-15, 8-10, 10-21, 10-15, 15-21, or 19-21) nucleosides in length to a CYP7A1 target sequence of nucleotides 1226-1246 of SEQ ID NO: 1.

In some embodiments, a CYP7A1 RNAi agent disclosed herein comprises a sense strand and an antisense strand, wherein the antisense strand comprises a region of complementary of 8-21 (e.g., 8-21, 8-15, 8-10, 10-21, 10-15, 15-21, or 19-21) nucleosides in length to a CYP7A1 target sequence of nucleotides 1235-1255 of SEQ ID NO: 1.

In some embodiments, a CYP7A1 RNAi agent disclosed herein comprises a sense strand and an antisense strand, wherein the antisense strand comprises a region of complementary of 8-21 (e.g., 8-21, 8-15, 8-10, 10-21, 10-15, 15-21, or 19-21) nucleosides in length to a CYP7A1 target sequence as set forth in any one of SEQ ID NOs: 9-776. In some embodiments, a CYP7A1 RNAi agent disclosed herein comprises a sense strand and an antisense strand, wherein the antisense strand comprises a region of complementary of 8, 9, 10, 11, 12, 13, 14, 15, 16, 17, 18, 19, 20, or 21 nucleosides in length to a CYP7A1 target sequence as set forth in any one of SEQ ID NOs: 9-776. For the purposes of the present disclosure, a region of complementary need not be 100% complementary to that of its target to be specifically hybridizable or specific for a CYP7A1 sequence. In some embodiments, the region of complementarity is at least 80%, at least 85%, at least 90%, at least 91%, at least 92%, at least 93%, at least 94%, at least 95%, at least 96%, at least 97%, at least 98%, at least 99% or 100% complementary to a target region in a CYP7A1 sequence. In some embodiments, the target region is a region of consecutive nucleosides in the CYP7A1 sequence. In some embodiments, the region of complementarity comprises a nucleoside sequence that contains no more than 1, 2, 3, 4, or 5 base mismatches compared to the complementary portion of a CYP7A1 sequence. In some embodiments, the region of complementarity comprises a nucleoside sequence that has up to 3 mismatches over 15 nucleosides, or up to 2 mismatches over 10 nucleosides. In some embodiments, in any one of the CYP7A1 RNAi agents disclosed herein, the sense strand is complementary or substantially complementary to the antisense strand.

In some embodiments, in any one of the CYP7A1 RNAi agents disclosed herein, the antisense strand is 15, 16, 17, 18, 19, 20, 21, 22, 23, 24, 25, 26, 27, 28, 29, or 30 nucleosides in length. In some embodiments, in any one of the CYP7A1 RNAi agents disclosed herein, the antisense strand is 19, 20, 21, 22, or 23 nucleosides in length. In some embodiments, in any one of the CYP7A1 RNAi agents disclosed herein, the sense strand is 15, 16, 17, 18, 19, 20, 21, 22, 23, 24, 25, 26, 27, 28, 29, or 30 nucleosides in length. In some embodiments, in any one of the CYP7A1 RNAi agents disclosed herein, the sense strand is 19, 20, 21, 22, or 23 nucleosides in length. In some embodiments, in any one of the CYP7A1 RNAi agents disclosed herein, the antisense strand is 19, 20, 21, 22, or 23 nucleosides in length and the sense strand is 19, 20, or 21 nucleosides in length. In some embodiments, in any one of the CYP7A1 RNAis agent disclosed herein, the antisense strand and the sense strand are of the same length, e.g., 19, 20, 21, 22, or 23 nucleosides in length. In some embodiments, in any one of the CYP7A1 RNAi agents disclosed herein, the antisense strand and the sense strand are of different lengths. In some embodiments, in any one of the CYP7A1 RNAi agents disclosed herein, the antisense strand is 23 nucleosides in length and the sense strand is 21 nucleosides in length.

In some embodiments, a CYP7A1 RNAi agent disclosed herein may be blunt-ended on both ends. In some embodiments, a CYP7A1 RNAi agent disclosed herein may be blunt-ended on one end and has an overhang (5' or 3' overhang) on the other end. In some embodiments, a CYP7A1 RNAi agent disclosed herein has an overhang (5' or 3' overhang) on both ends. In some embodiments, a CYP7A1 RNAi agent disclosed herein comprises a duplex region of 10, 11, 12, 13, 14, 15, 16, 17, 18, 19, 20, 21, 22, 23, 24, 25, 26, 27, 28, 29, or 30 base pairs in length. In some embodiments, a CYP7A1 RNAi agent disclosed herein comprises a duplex region of 19, 20, or 21 base pairs in length. In some embodiments, a CYP7A1 RNAi agent comprises an overhang (5' or 3' overhang) of at least 1 nucleoside on at least one strand. In some embodiments, a CYP7A1 RNAi agent comprises a 3' overhang of at least 1 nucleoside on at least one strand. In some embodiments, a CYP7A1 RNAi agent disclosed herein comprises a duplex region of 19, 20, 21 base pairs in length and comprises an overhang (5' or 3' overhang) of 1, 2, or 3 nucleosides in length on the sense strand. In some embodiments, a CYP7A1 RNAi agent disclosed herein comprises a duplex region of 19, 20, 21 base pairs in length and comprises an overhang (5' or 3' overhang) of 1, 2, or 3 nucleosides in length on the antisense strand. In some embodiments, a CYP7A1 RNAi agent disclosed herein comprises a duplex region of 19, 20, 21 base pairs in length and comprises a 3' overhang of 1, 2, or 3 nucleosides in length on the antisense strand. In some embodiments, a CYP7A1 RNAi agent disclosed herein comprises a duplex region of 19, 20, 21 base pairs in length and comprises a 3' overhang of 2 nucleosides on the antisense strand.

In some embodiments, a CYP7A1 RNAi agent described herein comprises an antisense strand that is 18-25 nucleosides (e.g., 18, 19, 20, 21, 22, 23, 24, or 25 nucleosides) in length and comprises a region of complementarity to a target sequence as set forth in any one of SEQ ID NOs: 9-776, wherein the region of complementarity is at least 15 nucleosides (e.g., 15, 16, 17, 18, 19, 20, 21, 22, or 23 nucleosides) in length. In some embodiments, the antisense strand is 23 nucleosides in length and comprises a region of complementarity to a target sequence as set forth in any one of SEQ ID NOs: 9-776, wherein the region of complementarity is 19, 20, 21, 22, or 23 nucleosides in length. In some embodiments, the region of complementarity is fully complementarity with all or a portion of its target sequence. In some embodiments, the region of complementarity includes 1, 2, 3 or more mismatches.

In some embodiments, a CYP7A1 RNAi agent described herein comprises an antisense strand that is 18-25 nucleosides (e.g., 18, 19, 20, 21, 22, 23, 24, or 25 nucleosides) in length and comprises at least 15 (e.g., 16, 17, 18, 19, 20, 21, 22, or 23) consecutive nucleobases of any one of SEQ ID NOs: 777-1190, and a sense strand that is 18-25 nucleosides (e.g., 18, 19, 20, 21, 22, 23, 24, or 25 nucleosides) in length and comprises at least 15 (e.g., 16, 17, 18, 19, 20, 21, 22, or 23) consecutive nucleobases of any one of SEQ ID NOs: 9-776.

In some embodiments, a CYP7A1 RNAi agent described herein comprises an antisense strand comprising nucleobases 2-21 (counting 5'→3') of any one of SEQ ID NOs: 777-1190 and a sense strand comprising the nucleobase sequence of any one of SEQ ID NOs: 393-776.

In some embodiments, a CYP7A1 RNAi agent described herein comprises an antisense strand that comprises the nucleobase sequence of any one of SEQ ID NOs: 777-1190, and further comprises a sense strand that is substantially complementary to the antisense strand and comprises the nucleobase sequence of any one of SEQ ID NOs: 393-776. In some embodiments, a CYP7A1 RNAi agent described herein comprises an antisense strand and a sense strand, wherein the antisense strand and the sense strand form a duplex region, and wherein the antisense strand is fully complementary to the sense strand within the duplex region. In some embodiments, a CYP7A1 RNAi agent described herein comprises an antisense strand and a sense strand, wherein the antisense strand and the sense strand form a duplex region, wherein the antisense strand is complementary to the sense strand within the duplex region, and wherein there are 1, 2, 3, 4, or 5 mismatches between the sense strand and antisense strand.

In some embodiments, a CYP7A1 RNAi agent described herein comprises an antisense strand that comprises nucleobases 2-21 (counting 5'→3') of a nucleobase sequence selected from (5'→3'):

```
(i)
                                    (SEQ ID NO: 1161)
UUUGCUCUGAGGAACUCAAGAAG

(ii)
                                    (SEQ ID NO: 1162)
UUGUCAUUGAGAAACAUGCGCAG

(iii)
                                    (SEQ ID NO: 1165)
UUAACUGUGGGUAAAGAGCUAAG

(iv)
                                    (SEQ ID NO: 1166)
UAUACUGGCAGGUCAUUCAGUAG

(v)
                                    (SEQ ID NO: 1169)
UGAUUUGUGAUGAAAUGGACAAG

(vi)
                                    (SEQ ID NO: 1173)
UCUAAGUGCAUUAACUGUGGGAG

(vii)
                                    (SEQ ID NO: 1174)
UUUAACUGUGGGUAAAGAGCUAG
```

-continued (viii)
(SEQ ID NO: 1180)
UCAAGAAUAAGCCAUAGACAAAG (ix)
(SEQ ID NO: 1181)
UUUCCGUGAGGGAAUUCAAGGAG (x)
(SEQ ID NO: 1184)
UGUAUGACAAGGGAUUUGUGAAG (xi)
(SEQ ID NO: 1188)
UAAAUACCCAGCUUCAAACAUAG;
and (xii)
(SEQ ID NO: 1190)
UAUGAUACGUUGGAGGUUUUCAG.

In some embodiments, a CYP7A1 RNAi agent described herein comprises an antisense strand that comprises a nucleobase sequence selected from (5'→3'):

(i)
(SEQ ID NO: 1161)
UUUGCUCUGAGGAACUCAAGAAG (ii)
(SEQ ID NO: 1162)
UUGUCAUUGAGAAACAUGCGCAG (iii)
(SEQ ID NO: 1165)
UUAACUGUGGGUAAAGAGCUAAG (iv)
(SEQ ID NO: 1166)
UAUACUGGCAGGUCAUUCAGUAG (v)
(SEQ ID NO: 1169)
UGAUUUGUGAUGAAAUGGACAAG (vi)
(SEQ ID NO: 1173)
UCUAAGUGCAUUAACUGUGGGAG (vii)
(SEQ ID NO: 1174)
UUUAACUGUGGGUAAAGAGCUAG (viii)
(SEQ ID NO: 1180)
UCAAGAAUAAGCCAUAGACAAAG (ix)
(SEQ ID NO: 1181)
UUUCCGUGAGGGAAUUCAAGGAG (x)
(SEQ ID NO: 1184)
UGUAUGACAAGGGAUUUGUGAAG (xi)
(SEQ ID NO: 1188)
UAAAUACCCAGCUUCAAACAUAG;
and (xii)
(SEQ ID NO: 1190)
UAUGAUACGUUGGAGGUUUUCAG.

In some embodiments, a CYP7A1 RNAi agent described herein comprises a sense strand that comprises a nucleobase sequence selected from (5'→3'):

(i)
(SEQ ID NO: 419)
UCUUGAGUUCCUCAGAGCAAA;

(ii)
(SEQ ID NO: 517)
GCGCAUGUUUCUCAAUGACAA;

(iii)
(SEQ ID NO: 597)
UAGCUCUUUACCCACAGUUAA;

(iv)
(SEQ ID NO: 566)
ACUGAAUGACCUGCCAGUAUA;

(v)
(SEQ ID NO: 439)
UGUCCAUUUCAUCACAAAUCA;

(vi)
(SEQ ID NO: 604)
CCCACAGUUAAUGCACUUAGA;

(vii)
(SEQ ID NO: 598)
AGCUCUUUACCCACAGUUAAA;

(viii)
(SEQ ID NO: 404)
UUGUCUAUGGCUUAUUCUUGA;

(ix)
(SEQ ID NO: 464)
CCUUGAAUUCCCUCACGGAAA;

(x)
(SEQ ID NO: 443)
UCACAAAUCCCUUGUCAUACA;

(xi)
(SEQ ID NO: 493)
AUGUUUGAAGCUGGGUAUUUA;
and (xii)
(SEQ ID NO: 473)
GAAAACCUCCAACGUAUCAUA.

In some embodiments, a CYP7A1 RNAi agent described herein comprises nucleobase sequences (e.g., nucleobase sequences of the antisense strand and the sense strand) of the siRNAs listed in Table 5A, Table 7A, and Table 9.

In some embodiments, a CYP7A1 RNAi agent described herein comprises nucleobase sequences (e.g., nucleobase sequences of the antisense strand and the sense strand) of the siRNAs selected from siRNA1-siRNA384, siRNA12', siRNA27', siRNA38', siRNA47', siRNA51', siRNA72', siRNA73', siRNA81', siRNA100', siRNA101', siRNA118', siRNA122', siRNA124', siRNA125', siRNA158', siRNA161', siRNA172', siRNA174', siRNA190', siRNA199', siRNA203', siRNA205', siRNA206', siRNA212', siRNA226', siRNA231', siRNA250', siRNA256', siRNA260', and siRNA272'. The siRNA numbers correspond to the siRNA numbers in Table 5A and Table 7A.

In some embodiments, a CYP7A1 RNAi agent described herein comprises nucleobase sequences (e.g., nucleobase sequences of the antisense strand and the sense strand) of the siRNA molecule selected from siRNA27', siRNA125', siRNA205', siRNA174', siRNA47', siRNA212', siRNA206', siRNA12', siRNA72', siRNA51', sRNA101', and siRNA81'. The siRNA numbers correspond to the siRNA numbers in Table 7A.

In some embodiments, a CYP7A1 RNAi agent described herein comprises nucleobase sequences (e.g., nucleobase sequences of the antisense strand and the sense strand) of the siRNA molecule selected from siRNA72', siRNA206', siRNA12', and siRNA212'. The siRNA numbers correspond to the siRNA numbers in Table 7A.

It is to be understood that, for the purposes of the present disclosure, a CYP7A1 RNAi agent comprising nucleobase sequences (e.g., nucleobase sequences of the antisense strand and the sense strand) of the siRNAs listed in Table 5A and Table 7A encompasses CYP7A1 RNAi agents comprising such nucleobase sequences and comprising no chemical modifications (e.g., modified nucleosides and/or modified internucleoside linkages), and CYP7A1 RNAi agents comprising such nucleobase sequences and comprising chemical modifications (e.g., one or more modified nucleosides and/or one or more modified internucleoside linkages; e.g., those provided in Table 5B, Table 7B, and Table 9), and encompasses such modified or unmodified RNAi agents unconjugated or conjugated to a targeting moiety.

In some embodiments, a CYP7A1 RNAi agent described herein comprises an antisense strand and sense strand, each comprising a structure as provided in Table 5B, Table 7B, or Table 9. In some embodiments, the CYP7A1 RNAi agent comprises an antisense strand comprising a structure as set forth in any one of SEQ ID NOs: 1605-2054. In some embodiments, the CYP7A1 RNAi agent comprises a sense strand comprising a structure as set forth in any one of SEQ ID NOs: 1191-1604. In some embodiments, the CYP7A1 RNAi agent comprises an antisense strand comprising a structure as set forth in any one of SEQ ID NOs: 1605-2054 and a sense strand comprising a structure as set forth in any one of SEQ ID NOs: 1191-1604. In some embodiments, the CYP7A1 RNAi agent is selected from any one of the siRNAs listed in Tables 5B, 7B, and 9.

In some embodiments, an RNAi agent described herein (e.g., the siRNAs listed in Tables 5A, 5B, 7A, 7B, and 9) comprises a sense strand of 21 nucleosides in length and an antisense strand of 23 nucleosides in length, resulting in an siRNA having a 2 nucleoside overhang at the 3' end of the antisense strand. In some embodiments, the 2 nucleoside overhang at the 3' end of the antisense strand is UU (e.g., the siRNAs listed in Tables 5A and 5B). In some embodiments, the 2 nucleoside overhang at the 3' end of the antisense strand is AG (e.g., the siRNAs listed in Tables 7A and 7B, and 9). It is to be understood that the present disclosure contemplates and encompasses any one of the siRNAs listed in Tables 5A, 5B, 7A, 7B, and 9 with the 2 nucleoside overhang at the 3' end of the antisense strand being replaced with an overhang of a different nucleobase sequence (e.g., any known overhangs such as UG, TG or TT) with the same or different chemical modifications (e.g., in the sugar moieties and/or the internucleoside linkages).

In some embodiments, an RNAi agent described herein has a U as the 5' terminal nucleoside of the antisense strand (i.e., position 1 counting from 5' to 3') (e.g., the siRNAs listed in Tables 5A, 5B, 7A, 7B, and 9). It is to be understood that the present disclosure contemplates and encompasses any one of the siRNAs listed in Tables 5A, 5B, 7A, 7B, and 9 with the 5' terminal U of the antisense strand replaced with a different nucleobase (e.g., A, T, G, or C) with the same or different chemical modification (e.g., in the sugar moiety and/or the internucleoside linkage).

In some embodiments, any one or more of the uracil bases (U's) in any one of the target sequences provided herein (e.g., the target sequences provided in Table 2) may independently and optionally be thymine bases (T's).

In some embodiments, any one or more of the uracil bases (U's) in any one of the siRNAs provided herein (e.g., the siRNAs listed in Tables 5A, 5B, 7A, 7B, and 9) may independently and optionally be thymine bases (T's).

In some embodiments, any one or more of the purine bases (G's or A's) in any one of the siRNAs provided herein (e.g., the siRNAs listed in Tables 5A, 5B, 7A, 7B, and 9) may independently and optionally be a base that can base pair with a pyrimidine base, e.g., inosine bases (I's).

In some embodiments, any one or more of the pyrimidine bases (C's or U's) in any one of the siRNAs provided herein (e.g., the siRNAs listed in Tables 5A, 5B, 7A, 7B, and 9) may independently and optionally be a base that can base pair with a purine base, e.g., inosine bases (I's).

In some embodiments, any one of the siRNAs provided herein (e.g., the siRNAs listed in Tables 5A, 5B, 7A, 7B, and 9) may comprise:

(i) a sense strand that comprises a 5'-OH or 5'-O-methyl (5'-O-Me);

(ii) a sense strand that comprises a 3'-OH;

(iii) an antisense strand that comprises a 5'-OH, 5'-phosphate, or 5'-vinylphosphonate; and/or (iv) an antisense strand that comprises a 3'-OH.

In some embodiments, any one of the siRNAs provided herein (e.g., the siRNAs listed in Tables 5A, 5B, 7A, 7B, and 9) may comprise:

(i) a sense strand that comprises a 5'-OH, or 5'-O-methyl (5'-O-Me);

(ii) a sense strand that is conjugated at the 3' end to a targeting moiety (e.g., via a phosphorothioate linkage);

(iii) an antisense strand that comprises a 5'-OH, 5'-phosphate, or 5'-vinylphosphonate; and/or (iv) an antisense strand that comprises a 3'-OH.

TABLE 2

CYP7A1 19-mer mRNA Target Sequences‡ (taken from human CYP7A1 mRNA transcript and cDNA sequence set forth in GenBank Accession No. NM_000780.4 (the RNA version of SEQ ID NO: 1, with all T's in SEQ ID NO: 1 replaced by U's))

| SEQ ID NO. | Position | Sequence |
|---|---|---|
| 9 | 34 | CUUCCUCAGAGAUUUUGGC |
| 10 | 40 | CAGAGAUUUUGGCCUAGAU |
| 11 | 41 | AGAGAUUUUGGCCUAGAUU |
| 12 | 42 | GAGAUUUUGGCCUAGAUUU |
| 13 | 43 | AGAUUUUGGCCUAGAUUUG |
| 14 | 45 | AUUUUGGCCUAGAUUUGCA |
| 15 | 105 | GCAUGCUGUUGUCUAUGGC |
| 16 | 110 | CUGUUGUCUAUGGCUUAUU |
| 17 | 111 | UGUUGUCUAUGGCUUAUUC |
| 18 | 112 | GUUGUCUAUGGCUUAUUCU |
| 19 | 113 | UUGUCUAUGGCUUAUUCUU |
| 20 | 115 | GUCUAUGGCUUAUUCUUGG |

TABLE 2-continued

| CYP7A1 19-mer mRNA Target Sequences‡ (taken from human CYP7A1 mRNA transcript and cDNA sequence set forth in GenBank Accession No. NM_000780.4 (the RNA version of SEQ ID NO: 1, with all T's in SEQ ID NO: 1 replaced by U's)) | | |
|---|---|---|
| SEQ ID NO. | Position | Sequence |
| 21 | 116 | UCUAUGGCUUAUUCUUGGA |
| 22 | 117 | CUAUGGCUUAUUCUUGGAA |
| 23 | 118 | UAUGGCUUAUUCUUGGAAU |
| 24 | 139 | GGAGAAGGCAAACGGGUGA |
| 25 | 141 | AGAAGGCAAACGGGUGAAC |
| 26 | 142 | GAAGGCAAACGGGUGAACC |
| 27 | 143 | AAGGCAAACGGGUGAACCA |
| 28 | 181 | UUCCAUACCUGGGCUGUGC |
| 29 | 182 | UCCAUACCUGGGCUGUGCU |
| 30 | 183 | CCAUACCUGGGCUGUGCUC |
| 31 | 201 | CUGCAAUUUGGUGCCAAUC |
| 32 | 203 | GCAAUUUGGUGCCAAUCCU |
| 33 | 210 | GGUGCCAAUCCUCUUGAGU |
| 34 | 214 | CCAAUCCUCUUGAGUUCCU |
| 35 | 223 | UUGAGUUCCUCAGAGCAAA |
| 36 | 225 | GAGUUCCUCAGAGCAAAUC |
| 37 | 229 | UCCUCAGAGCAAAUCAAAG |
| 38 | 230 | CCUCAGAGCAAAUCAAAGG |
| 39 | 236 | AGCAAAUCAAAGGAAACAU |
| 40 | 238 | CAAAUCAAAGGAAACAUGG |
| 41 | 242 | UCAAAGGAAACAUGGUCAU |
| 42 | 243 | CAAAGGAAACAUGGUCAUG |
| 43 | 244 | AAAGGAAACAUGGUCAUGU |
| 44 | 245 | AAGGAAACAUGGUCAUGUU |
| 45 | 246 | AGGAAACAUGGUCAUGUUU |
| 46 | 251 | ACAUGGUCAUGUUUUUACC |
| 47 | 253 | AUGGUCAUGUUUUUACCUG |
| 48 | 254 | UGGUCAUGUUUUUACCUGC |
| 49 | 262 | UUUUUACCUGCAAACUAAU |
| 50 | 264 | UUUACCUGCAAACUAAUGG |
| 51 | 266 | UACCUGCAAACUAAUGGGA |
| 52 | 267 | ACCUGCAAACUAAUGGGAA |
| 53 | 268 | CCUGCAAACUAAUGGGAAA |
| 54 | 291 | GUCCAUUUCAUCACAAAUC |
| 55 | 292 | UCCAUUUCAUCACAAAUCC |

TABLE 2-continued

| CYP7A1 19-mer mRNA Target Sequences‡ (taken from human CYP7A1 mRNA transcript and cDNA sequence set forth in GenBank Accession No. NM_000780.4 (the RNA version of SEQ ID NO: 1, with all T's in SEQ ID NO: 1 replaced by U's)) | | |
|---|---|---|
| SEQ ID NO. | Position | Sequence |
| 56 | 294 | CAUUUCAUCACAAAUCCCU |
| 57 | 300 | AUCACAAAUCCCUUGUCAU |
| 58 | 302 | CACAAAUCCCUUGUCAUAC |
| 59 | 303 | ACAAAUCCCUUGUCAUACC |
| 60 | 304 | CAAAUCCCUUGUCAUACCA |
| 61 | 305 | AAAUCCCUUGUCAUACCAU |
| 62 | 309 | CCCUUGUCAUACCAUAAGG |
| 63 | 310 | CCUUGUCAUACCAUAAGGU |
| 64 | 311 | CUUGUCAUACCAUAAGGUG |
| 65 | 312 | UUGUCAUACCAUAAGGUGU |
| 66 | 313 | UGUCAUACCAUAAGGUGUU |
| 67 | 315 | UCAUACCAUAAGGUGUUGU |
| 68 | 319 | ACCAUAAGGUGUUGUGCCA |
| 69 | 360 | AAAUUUCACUUUGCUACUU |
| 70 | 363 | UUUCACUUUGCUACUUCUG |
| 71 | 372 | GCUACUUCUGCGAAGGCAU |
| 72 | 375 | ACUUCUGCGAAGGCAUUUG |
| 73 | 377 | UUCUGCGAAGGCAUUUGGG |
| 74 | 390 | UUUGGGCACAGAAGCAUUG |
| 75 | 392 | UGGGCACAGAAGCAUUGAC |
| 76 | 394 | GGCACAGAAGCAUUGACCC |
| 77 | 474 | GCCUUGAAUUCCCUCACGG |
| 78 | 475 | CCUUGAAUUCCCUCACGGA |
| 79 | 476 | CUUGAAUUCCCUCACGGAA |
| 80 | 477 | UUGAAUUCCCUCACGGAAA |
| 81 | 478 | UGAAUUCCCUCACGGAAAG |
| 82 | 482 | UUCCCUCACGGAAAGCAUG |
| 83 | 484 | CCCUCACGGAAAGCAUGAU |
| 84 | 486 | CUCACGGAAAGCAUGAUGG |
| 85 | 488 | CACGGAAAGCAUGAUGGAA |
| 86 | 501 | AUGGAAAACCUCCAACGUA |
| 87 | 503 | GGAAAACCUCCAACGUAUC |
| 88 | 505 | AAAACCUCCAACGUAUCAU |
| 89 | 506 | AAACCUCCAACGUAUCAUG |
| 90 | 507 | AACCUCCAACGUAUCAUGA |
| 91 | 509 | CCUCCAACGUAUCAUGAGA |

TABLE 2-continued

CYP7A1 19-mer mRNA Target Sequences‡ (taken from human CYP7A1 mRNA transcript and cDNA sequence set forth in GenBank Accession No. NM_000780.4 (the RNA version of SEQ ID NO: 1, with all T's in SEQ ID NO: 1 replaced by U's))

| SEQ ID NO. | Position | Sequence |
|---|---|---|
| 92 | 510 | CUCCAACGUAUCAUGAGAC |
| 93 | 511 | UCCAACGUAUCAUGAGACC |
| 94 | 512 | CCAACGUAUCAUGAGACCU |
| 95 | 513 | CAACGUAUCAUGAGACCUC |
| 96 | 514 | AACGUAUCAUGAGACCUCC |
| 97 | 539 | CUCUAACUCAAAGACCGCU |
| 98 | 552 | ACCGCUGCCUGGGUGACAG |
| 99 | 562 | GGGUGACAGAAGGGAUGUA |
| 100 | 563 | GGUGACAGAAGGGAUGUAU |
| 101 | 564 | GUGACAGAAGGGAUGUAUU |
| 102 | 585 | UUCUGCUACCGAGUGAUGU |
| 103 | 587 | CUGCUACCGAGUGAUGUUU |
| 104 | 588 | UGCUACCGAGUGAUGUUUG |
| 105 | 589 | GCUACCGAGUGAUGUUUGA |
| 106 | 593 | CCGAGUGAUGUUUGAAGCU |
| 107 | 594 | CGAGUGAUGUUUGAAGCUG |
| 108 | 595 | GAGUGAUGUUUGAAGCUGG |
| 109 | 602 | GUUUGAAGCUGGGUAUUUA |
| 110 | 605 | UGAAGCUGGGUAUUUAACU |
| 111 | 606 | GAAGCUGGGUAUUUAACUA |
| 112 | 607 | AAGCUGGGUAUUUAACUAU |
| 113 | 608 | AGCUGGGUAUUUAACUAUC |
| 114 | 609 | GCUGGGUAUUUAACUAUCU |
| 115 | 610 | CUGGGUAUUUAACUAUCUU |
| 116 | 612 | GGGUAUUUAACUAUCUUUG |
| 117 | 613 | GGUAUUUAACUAUCUUUGG |
| 118 | 653 | CACACAGAAAGCACAUAUU |
| 119 | 663 | GCACAUAUUCUAAACAAUC |
| 120 | 665 | ACAUAUUCUAAACAAUCUU |
| 121 | 666 | CAUAUUCUAAACAAUCUUG |
| 122 | 667 | AUAUUCUAAACAAUCUUGA |
| 123 | 669 | AUUCUAAACAAUCUUGACA |
| 124 | 670 | UUCUAAACAAUCUUGACAA |
| 125 | 671 | UCUAAACAAUCUUGACAAC |
| 126 | 673 | UAAACAAUCUUGACAACUU |
| 127 | 679 | AUCUUGACAACUUCAAGCA |
| 128 | 712 | UUCCAGCCCUGGUAGCAGG |
| 129 | 771 | GAGAAACUGGCAGAGAGCU |
| 130 | 781 | CAGAGAGCUUGAGGCACGA |
| 131 | 788 | CUUGAGGCACGAGAACCUC |
| 132 | 841 | UGCGCAUGUUUCUCAAUGA |
| 133 | 844 | GCAUGUUUCUCAAUGACAC |
| 134 | 846 | AUGUUUCUCAAUGACACUU |
| 135 | 850 | UUCUCAAUGACACUUUGUC |
| 136 | 851 | UCUCAAUGACACUUUGUCC |
| 137 | 852 | CUCAAUGACACUUUGUCCA |
| 138 | 861 | ACUUUGUCCACCUUUGAUG |
| 139 | 862 | CUUUGUCCACCUUUGAUGA |
| 140 | 901 | ACCUCGUGGUCCUCUGGGC |
| 141 | 903 | CUCGUGGUCCUCUGGGCAU |
| 142 | 904 | UCGUGGUCCUCUGGGCAUC |
| 143 | 905 | CGUGGUCCUCUGGGCAUCG |
| 144 | 906 | GUGGUCCUCUGGGCAUCGC |
| 145 | 912 | CUCUGGGCAUCGCAAGCAA |
| 146 | 915 | UGGGCAUCGCAAGCAAACA |
| 147 | 916 | GGGCAUCGCAAGCAAACAC |
| 148 | 917 | GGCAUCGCAAGCAAACACC |
| 149 | 920 | AUCGCAAGCAAACACCAUU |
| 150 | 921 | UCGCAAGCAAACACCAUUC |
| 151 | 950 | CUGGAGUUUAUUUCAAAUG |
| 152 | 954 | AGUUUAUUUCAAAUGAUUA |
| 153 | 955 | GUUUAUUUCAAAUGAUUAG |
| 154 | 956 | UUUAUUUCAAAUGAUUAGG |
| 155 | 957 | UUAUUUCAAAUGAUUAGGA |
| 156 | 980 | AGAAGCAAUGAAAGCAGCU |
| 157 | 982 | AAGCAAUGAAAGCAGCUAC |
| 158 | 983 | AGCAAUGAAAGCAGCUACU |
| 159 | 988 | UGAAAGCAGCUACUGAAGA |
| 160 | 989 | GAAAGCAGCUACUGAAGAA |
| 161 | 992 | AGCAGCUACUGAAGAAGUG |
| 162 | 993 | GCAGCUACUGAAGAAGUGA |

TABLE 2-continued

CYP7A1 19-mer mRNA Target Sequences‡ (taken from human CYP7A1 mRNA transcript and cDNA sequence set forth in GenBank Accession No. NM_000780.4 (the RNA version of SEQ ID NO: 1, with all T's in SEQ ID NO: 1 replaced by U's))

| SEQ ID NO. | Position | Sequence |
|---|---|---|
| 163 | 994 | CAGCUACUGAAGAAGUGAA |
| 164 | 995 | AGCUACUGAAGAAGUGAAA |
| 165 | 996 | GCUACUGAAGAAGUGAAAA |
| 166 | 1005 | GAAGUGAAAAGAACAUUAG |
| 167 | 1006 | AAGUGAAAAGAACAUUAGA |
| 168 | 1007 | AGUGAAAAGAACAUUAGAG |
| 169 | 1011 | AAAAGAACAUUAGAGAAUG |
| 170 | 1012 | AAAGAACAUUAGAGAAUGC |
| 171 | 1013 | AAGAACAUUAGAGAAUGCU |
| 172 | 1018 | CAUUAGAGAAUGCUGGUCA |
| 173 | 1019 | AUUAGAGAAUGCUGGUCAA |
| 174 | 1020 | UUAGAGAAUGCUGGUCAAA |
| 175 | 1021 | UAGAGAAUGCUGGUCAAAA |
| 176 | 1026 | AAUGCUGGUCAAAAAGUCA |
| 177 | 1027 | AUGCUGGUCAAAAAGUCAG |
| 178 | 1029 | GCUGGUCAAAAAGUCAGCU |
| 179 | 1036 | AAAAAGUCAGCUUGGAAGG |
| 180 | 1039 | AAGUCAGCUUGGAAGGCAA |
| 181 | 1042 | UCAGCUUGGAAGGCAAUCC |
| 182 | 1084 | UGAAUGACCUGCCAGUAUU |
| 183 | 1087 | AUGACCUGCCAGUAUUAGA |
| 184 | 1134 | UCCAGUGCCUCCCUCAACA |
| 185 | 1151 | CAUCCGGACAGCUAAGGAG |
| 186 | 1152 | AUCCGGACAGCUAAGGAGG |
| 187 | 1155 | CGGACAGCUAAGGAGGAUU |
| 188 | 1158 | ACAGCUAAGGAGGAUUUCA |
| 189 | 1160 | AGCUAAGGAGGAUUUCACU |
| 190 | 1162 | CUAAGGAGGAUUUCACUUU |
| 191 | 1165 | AGGAGGAUUUCACUUUGCA |
| 192 | 1168 | AGGAUUUCACUUUGCACCU |
| 193 | 1169 | GGAUUUCACUUUGCACCUU |
| 194 | 1174 | UCACUUUGCACCUUGAGGA |
| 195 | 1177 | CUUUGCACCUUGAGGACGG |
| 196 | 1178 | UUUGCACCUUGAGGACGGU |
| 197 | 1189 | AGGACGGUUCCUACAACAU |
| 198 | 1191 | GACGGUUCCUACAACAUCC |
| 199 | 1194 | GGUUCCUACAACAUCCGAA |
| 200 | 1196 | UUCCUACAACAUCCGAAAA |
| 201 | 1200 | UACAACAUCCGAAAAGAUG |
| 202 | 1201 | ACAACAUCCGAAAAGAUGA |
| 203 | 1203 | AACAUCCGAAAAGAUGACA |
| 204 | 1204 | ACAUCCGAAAAGAUGACAU |
| 205 | 1205 | CAUCCGAAAAGAUGACAUC |
| 206 | 1207 | UCCGAAAAGAUGACAUCAU |
| 207 | 1209 | CGAAAAGAUGACAUCAUAG |
| 208 | 1212 | AAAGAUGACAUCAUAGCUC |
| 209 | 1214 | AGAUGACAUCAUAGCUCUU |
| 210 | 1215 | GAUGACAUCAUAGCUCUUU |
| 211 | 1217 | UGACAUCAUAGCUCUUUAC |
| 212 | 1226 | AGCUCUUUACCCACAGUUA |
| 213 | 1227 | GCUCUUUACCCACAGUUAA |
| 214 | 1228 | CUCUUUACCCACAGUUAAU |
| 215 | 1229 | UCUUUACCCACAGUUAAUG |
| 216 | 1230 | CUUUACCCACAGUUAAUGC |
| 217 | 1231 | UUUACCCACAGUUAAUGCA |
| 218 | 1233 | UACCCACAGUUAAUGCACU |
| 219 | 1236 | CCACAGUUAAUGCACUUAG |
| 220 | 1237 | CACAGUUAAUGCACUUAGA |
| 221 | 1238 | ACAGUUAAUGCACUUAGAU |
| 222 | 1239 | CAGUUAAUGCACUUAGAUC |
| 223 | 1240 | AGUUAAUGCACUUAGAUCC |
| 224 | 1241 | GUUAAUGCACUUAGAUCCA |
| 225 | 1242 | UUAAUGCACUUAGAUCCAG |
| 226 | 1248 | CACUUAGAUCCAGAAAUCU |
| 227 | 1249 | ACUUAGAUCCAGAAAUCUA |
| 228 | 1261 | AAAUCUACCCAGACCCUUU |
| 229 | 1283 | UUUUAAAUAUGAUAGGUAU |
| 230 | 1285 | UUAAAUAUGAUAGGUAUCU |
| 231 | 1286 | UAAAUAUGAUAGGUAUCUU |
| 232 | 1288 | AAUAUGAUAGGUAUCUUGA |
| 233 | 1290 | UAUGAUAGGUAUCUUGAUG |

TABLE 2-continued

CYP7A1 19-mer mRNA Target Sequences‡ (taken from human CYP7A1 mRNA transcript and cDNA sequence set forth in GenBank Accession No. NM_000780.4 (the RNA version of SEQ ID NO: 1, with all T's in SEQ ID NO: 1 replaced by U's))

| SEQ ID NO. | Position | Sequence |
|---|---|---|
| 234 | 1291 | AUGAUAGGUAUCUUGAUGA |
| 235 | 1292 | UGAUAGGUAUCUUGAUGAA |
| 236 | 1293 | GAUAGGUAUCUUGAUGAAA |
| 237 | 1296 | AGGUAUCUUGAUGAAAACG |
| 238 | 1297 | GGUAUCUUGAUGAAAACGG |
| 239 | 1298 | GUAUCUUGAUGAAAACGGG |
| 240 | 1299 | UAUCUUGAUGAAAACGGGA |
| 241 | 1300 | AUCUUGAUGAAAACGGGAA |
| 242 | 1301 | UCUUGAUGAAAACGGGAAG |
| 243 | 1302 | CUUGAUGAAAACGGGAAGA |
| 244 | 1303 | UUGAUGAAAACGGGAAGAC |
| 245 | 1306 | AUGAAAACGGGAAGACAAA |
| 246 | 1307 | UGAAAACGGGAAGACAAAG |
| 247 | 1311 | AACGGGAAGACAAAGACUA |
| 248 | 1313 | CGGGAAGACAAAGACUACC |
| 249 | 1314 | GGGAAGACAAAGACUACCU |
| 250 | 1353 | UUAAAGUAUUACUACAUGC |
| 251 | 1354 | UAAAGUAUUACUACAUGCC |
| 252 | 1358 | GUAUUACUACAUGCCCUUU |
| 253 | 1360 | AUUACUACAUGCCCUUUGG |
| 254 | 1361 | UUACUACAUGCCCUUUGGA |
| 255 | 1363 | ACUACAUGCCCUUUGGAUC |
| 256 | 1364 | CUACAUGCCCUUUGGAUCG |
| 257 | 1382 | GGGAGCUACAAUAUGUCCU |
| 258 | 1386 | GCUACAAUAUGUCCUGGAA |
| 259 | 1388 | UACAAUAUGUCCUGGAAGA |
| 260 | 1389 | ACAAUAUGUCCUGGAAGAU |
| 261 | 1413 | GCUAUCCACGAAAUCAAGC |
| 262 | 1415 | UAUCCACGAAAUCAAGCAA |
| 263 | 1416 | AUCCACGAAAUCAAGCAAU |
| 264 | 1417 | UCCACGAAAUCAAGCAAUU |
| 265 | 1424 | AAUCAAGCAAUUUUUGAUU |
| 266 | 1425 | AUCAAGCAAUUUUUGAUUC |
| 267 | 1431 | CAAUUUUUGAUUCUGAUGC |
| 268 | 1433 | AUUUUUGAUUCUGAUGCUU |

TABLE 2-continued

CYP7A1 19-mer mRNA Target Sequences‡ (taken from human CYP7A1 mRNA transcript and cDNA sequence set forth in GenBank Accession No. NM_000780.4 (the RNA version of SEQ ID NO: 1, with all T's in SEQ ID NO: 1 replaced by U's))

| SEQ ID NO. | Position | Sequence |
|---|---|---|
| 269 | 1506 | CAGUCCCGGGCAGGCUUGG |
| 270 | 1507 | AGUCCCGGGCAGGCUUGGG |
| 271 | 1510 | CCCGGGCAGGCUUGGGCAU |
| 272 | 1511 | CCGGGCAGGCUUGGGCAUU |
| 273 | 1513 | GGGCAGGCUUGGGCAUUUU |
| 274 | 1518 | GGCUUGGGCAUUUUGCCGC |
| 275 | 1555 | UUAAAUAUAAAUUCAAGCA |
| 276 | 1556 | UAAAUAUAAAUUCAAGCAU |
| 277 | 1557 | AAAUAUAAAUUCAAGCAUU |
| 278 | 1558 | AAUAUAAAUUCAAGCAUUU |
| 279 | 1559 | AUAUAAAUUCAAGCAUUUG |
| 280 | 1561 | AUAAAUUCAAGCAUUUGUG |
| 281 | 1593 | AAUAAGAGGACACUAGAUG |
| 282 | 1594 | AUAAGAGGACACUAGAUGA |
| 283 | 1597 | AGAGGACACUAGAUGAUAU |
| 284 | 1599 | AGGACACUAGAUGAUAUUA |
| 285 | 1601 | GACACUAGAUGAUAUUACA |
| 286 | 1605 | CUAGAUGAUAUUACAGGAC |
| 287 | 1606 | UAGAUGAUAUUACAGGACU |
| 288 | 1609 | AUGAUAUUACAGGACUGCA |
| 289 | 1610 | UGAUAUUACAGGACUGCAG |
| 290 | 1614 | AUUACAGGACUGCAGAACA |
| 291 | 1638 | ACCACACAGUCCCUUUGGA |
| 292 | 1660 | AUGCAUUUAGUGGUGGUAG |
| 293 | 1661 | UGCAUUUAGUGGUGGUAGA |
| 294 | 1662 | GCAUUUAGUGGUGGUAGAA |
| 295 | 1663 | CAUUUAGUGGUGGUAGAAA |
| 296 | 1669 | GUGGUGGUAGAAAUGAUUC |
| 297 | 1671 | GGUGGUAGAAAUGAUUCAC |
| 298 | 1673 | UGGUAGAAAUGAUUCACCA |
| 299 | 1676 | UAGAAAUGAUUCACCAGGU |
| 300 | 1683 | GAUUCACCAGGUCCAAUGU |
| 301 | 1686 | UCACCAGGUCCAAUGUUGU |
| 302 | 1689 | CCAGGUCCAAUGUUGUUCA |
| 303 | 1690 | CAGGUCCAAUGUUGUUCAC |
| 304 | 1692 | GGUCCAAUGUUGUUCACCA |

TABLE 2-continued

CYP7A1 19-mer mRNA Target Sequences‡ (taken from human CYP7A1 mRNA transcript and cDNA sequence set forth in GenBank Accession No. NM_000780.4 (the RNA version of SEQ ID NO: 1, with all T's in SEQ ID NO: 1 replaced by U's))

| SEQ ID NO. | Position | Sequence |
|---|---|---|
| 305 | 1712 | UGCUUGCUUGUGAAUCUUA |
| 306 | 1713 | GCUUGCUUGUGAAUCUUAA |
| 307 | 1769 | UGCUAGUGAAAAGAACUAG |
| 308 | 1770 | GCUAGUGAAAAGAACUAGU |
| 309 | 1824 | AGUCCAUGAAUGUUCAUAU |
| 310 | 1825 | GUCCAUGAAUGUUCAUAUA |
| 311 | 1826 | UCCAUGAAUGUUCAUAUAG |
| 312 | 1827 | CCAUGAAUGUUCAUAUAGC |
| 313 | 1828 | CAUGAAUGUUCAUAUAGCC |
| 314 | 1829 | AUGAAUGUUCAUAUAGCCA |
| 315 | 1830 | UGAAUGUUCAUAUAGCCAG |
| 316 | 1895 | UUUUUCAAAAUGAAGAUAC |
| 317 | 2052 | UAUUCUAAUUGGCAGAUUG |
| 318 | 2053 | AUUCUAAUUGGCAGAUUGU |
| 319 | 2075 | UUCCUAAGGAAACUGCUUU |
| 320 | 2127 | AUGUUCAAAUUCACGUUCU |
| 321 | 2128 | UGUUCAAAUUCACGUUCUA |
| 322 | 2132 | CAAAUUCACGUUCUAGUGA |
| 323 | 2133 | AAAUUCACGUUCUAGUGAA |
| 324 | 2134 | AAUUCACGUUCUAGUGAAA |
| 325 | 2135 | AUUCACGUUCUAGUGAAAC |
| 326 | 2136 | UUCACGUUCUAGUGAAACU |
| 327 | 2137 | UCACGUUCUAGUGAAACUG |
| 328 | 2139 | ACGUUCUAGUGAAACUGCA |
| 329 | 2140 | CGUUCUAGUGAAACUGCAU |
| 330 | 2144 | CUAGUGAAACUGCAUUAUU |
| 331 | 2189 | GGUGUGAUCAUAUAUCAUA |
| 332 | 2190 | GUGUGAUCAUAUAUCAUAA |
| 333 | 2191 | UGUGAUCAUAUAUCAUAAA |
| 334 | 2192 | GUGAUCAUAUAUCAUAAAG |
| 335 | 2193 | UGAUCAUAUAUCAUAAAGG |
| 336 | 2194 | GAUCAUAUAUCAUAAAGGA |
| 337 | 2195 | AUCAUAUAUCAUAAAGGAU |
| 338 | 2199 | UAUAUCAUAAAGGAUAUUU |
| 339 | 2209 | AGGAUAUUUCAAAUGAUUA |

TABLE 2-continued

CYP7A1 19-mer mRNA Target Sequences‡ (taken from human CYP7A1 mRNA transcript and cDNA sequence set forth in GenBank Accession No. NM_000780.4 (the RNA version of SEQ ID NO: 1, with all T's in SEQ ID NO: 1 replaced by U's))

| SEQ ID NO. | Position | Sequence |
|---|---|---|
| 340 | 2210 | GGAUAUUUCAAAUGAUUAU |
| 341 | 2211 | GAUAUUUCAAAUGAUUAUG |
| 342 | 2215 | UUUCAAAUGAUUAUGAUUA |
| 343 | 2216 | UUCAAAUGAUUAUGAUUAG |
| 344 | 2217 | UCAAAUGAUUAUGAUUAGU |
| 345 | 2218 | CAAAUGAUUAUGAUUAGUU |
| 346 | 2220 | AAUGAUUAUGAUUAGUUAU |
| 347 | 2221 | AUGAUUAUGAUUAGUUAUG |
| 348 | 2223 | GAUUAUGAUUAGUUAUGUC |
| 349 | 2224 | AUUAUGAUUAGUUAUGUCU |
| 350 | 2225 | UUAUGAUUAGUUAUGUCUU |
| 351 | 2313 | GAUUUCCCAAAAACACUAA |
| 352 | 2316 | UUCCCAAAAACACUAAAGG |
| 353 | 2317 | UCCCAAAAACACUAAAGGU |
| 354 | 2319 | CCAAAAACACUAAAGGUGG |
| 355 | 2320 | CAAAAACACUAAAGGUGGU |
| 356 | 2321 | AAAAACACUAAAGGUGGUU |
| 357 | 2353 | AUGUUUUAACUUAUUGUUG |
| 358 | 2355 | GUUUUAACUUAUUGUUGCU |
| 359 | 2356 | UUUUAACUUAUUGUUGCUG |
| 360 | 2362 | CUUAUUGUUGCUGAAAACU |
| 361 | 2364 | UAUUGUUGCUGAAAACUCU |
| 362 | 2365 | AUUGUUGCUGAAAACUCUA |
| 363 | 2366 | UUGUUGCUGAAAACUCUAU |
| 364 | 2370 | UGCUGAAAACUCUAUGUCC |
| 365 | 2503 | AAAUGUAGCUUUUAUGUGA |
| 366 | 2562 | AAGCUUUGGUUAUGAAACA |
| 367 | 2563 | AGCUUUGGUUAUGAAACAU |
| 368 | 2620 | UUAAAUGCUUUUUAUCGCU |
| 369 | 2621 | UAAAUGCUUUUUAUCGCUA |
| 370 | 2622 | AAAUGCUUUUUAUCGCUAA |
| 371 | 2623 | AAUGCUUUUUAUCGCUAAA |
| 372 | 2624 | AUGCUUUUUAUCGCUAAAU |
| 373 | 2625 | UGCUUUUUAUCGCUAAAUG |
| 374 | 2629 | UUUUAUCGCUAAAUGACUU |
| 375 | 2630 | UUUAUCGCUAAAUGACUUG |

TABLE 2-continued

CYP7A1 19-mer mRNA Target Sequences‡ (taken from human CYP7A1 mRNA transcript and cDNA sequence set forth in GenBank Accession No. NM_000780.4 (the RNA version of SEQ ID NO: 1, with all T's in SEQ ID NO: 1 replaced by U's))

| SEQ ID NO. | Position | Sequence |
|---|---|---|
| 376 | 2632 | UAUCGCUAAAUGACUUGCA |
| 377 | 2633 | AUCGCUAAAUGACUUGCAG |
| 378 | 2635 | CGCUAAAUGACUUGCAGAU |
| 379 | 2639 | AAAUGACUUGCAGAUGAAA |
| 380 | 2679 | UUUAAAUGCUGUGUACAAC |
| 381 | 2682 | AAAUGCUGUGUACAACAAU |
| 382 | 2683 | AAUGCUGUGUACAACAAUG |
| 383 | 2687 | CUGUGUACAACAAUGCUUU |
| 384 | 2690 | UGUACAACAAUGCUUUGAU |
| 385 | 2691 | GUACAACAAUGCUUUGAUA |
| 386 | 2692 | UACAACAAUGCUUUGAUAA |
| 387 | 2833 | UAAUUUUGAAAUGAUUCAU |
| 388 | 2834 | AAUUUUGAAAUGAUUCAUC |
| 389 | 2835 | AUUUUGAAAUGAUUCAUCU |
| 390 | 2838 | UUGAAAUGAUUCAUCUUUC |
| 391 | 2839 | UGAAAUGAUUCAUCUUUCA |
| 392 | 2858 | GAAAUAAAAGUAUGAAUCU |

‡Each uracil base (U) in any one of the target sequences provided in Table 2 may independently and optionally be replaced with a thymine base (T).

Modified RNAi Agents (e.g., Modified CYP7A1 RNAi Agents)

Some aspects of the present disclosure provide modified RNAi agents (e.g., modified CYP7A1 RNAi agents). In some embodiments, a modified RNAi agent (e.g., modified CYP7A1 RNAi agent) comprise modified nucleosides and/or modified internucleoside linkages.

In some embodiments, an RNAi agent (e.g., a CYP7A1 RNAi agent described herein) comprises one or more (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, or more) modified nucleosides and/or one or more (e.g., 1, 2, 3, 4, 5, 6, 7, 8, 9, 10, or more) modified internucleoside linkages. In some embodiments, a modified nucleoside comprises a modification at the 2' position of the sugar (referred to herein as a "2'-modified nucleoside"). In some embodiments, all modified nucleosides in an RNAi agent (e.g., a CYP7A1 RNAi agent described herein) are 2'-modified nucleosides. In some embodiments, the 2'-modified nucleoside is selected from 2'-fluoro (2'-F), 2'-O-methyl (2'-O-Me), 2'-O-methoxyethyl (2'-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O-NMA) modified nucleoside, and combinations thereof. In some embodiments, an RNAi agent (e.g., a CYP7A1 RNAi agent described herein) comprises a mix of two or more different 2'-modified nucleosides (e.g., any combination of 2'-F modified nucleosides, 2'-O-Me modified nucleosides and 2'-MOE modified nucleosides).

In some embodiments, an RNAi agent (e.g., a CYP7A1 RNAi agent described herein) comprises one or more (e.g., 1, 2, 3, 4, 5, 6, 7, 8, 9, 10, or more) modified internucleoside linkages. Nonlimiting examples of internucleoside linkages include phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, mesyl phosphoramidates, thionophosphoramidates, thionoalkylphosphonates, thionoalkylphosphotriesters, and boranophosphates. In some embodiments, an RNAi agent (e.g., a CYP7A1 RNAi agent described herein) comprises one or more (e.g., 1, 2, 3, 4, 5, 6, 7, 8, 9, 10, or more) phosphorothioate internucleoside linkages.

Table 3 lists various exemplary nucleosides with 3'-phosphate or 3'-phosphorothioate and the structures thereof.

TABLE 3

Exemplary nucleosides with 3'-phosphate or 3'-phosphorothioate and structures

| Abbreviation | Nucleosides or linkage | Structure |
|---|---|---|
| A | Adenosine-3'-phosphate | 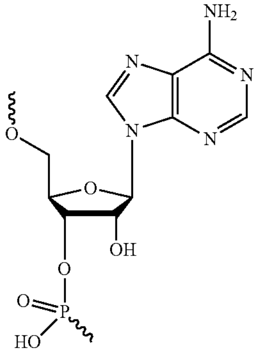 |

TABLE 3-continued
| Abbreviation | Nucleosides or linkage | Structure |
|---|---|---|
| fA | 2'-fluoroadenosine-3'-phosphate | 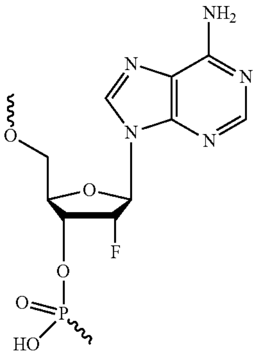 |
| fAs | 2'-fluoroadenosine-3'-phosphorothioate | 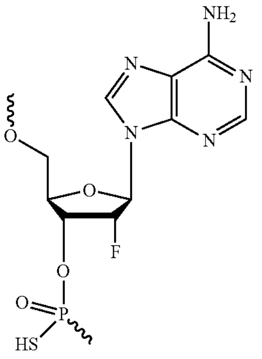 |
| C | Cytidine-3'-phosphate | 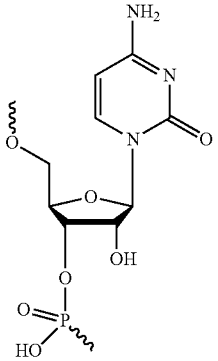 |
| fC | 2'-fluorocytidine-3'-phosphate | 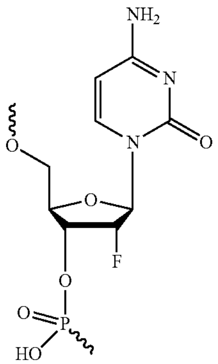 |
Exemplary nucleosides with 3'-phosphate or 3'-phosphorothioate and structures TABLE 3-continued
| Exemplary nucleosides with 3'-phosphate or 3'-phosphorothioate and structures | | |
|---|---|---|
| Abbreviation | Nucleosides or linkage | Structure |
| fCs | 2'-fluorocytidine-3'-phosphorothioate | 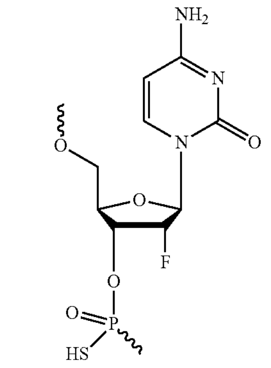 |
| G | Guanosine-3'-phosphate | 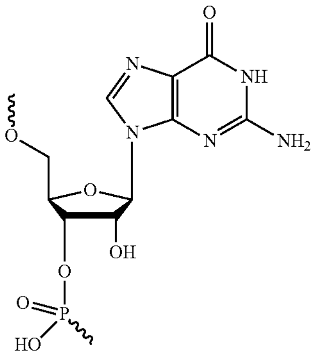 |
| fG | 2'-fluoroguanosine-3'-phosphate | 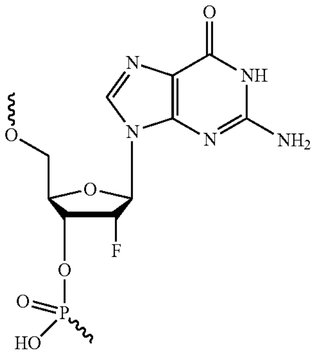 |
| fGs | 2'-fluoroguanosine-3'-phosphorothioate | 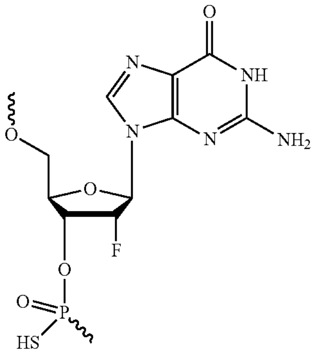 |

TABLE 3-continued
| Exemplary nucleosides with 3'-phosphate or 3'-phosphorothioate and structures | | |
|---|---|---|
| Abbreviation | Nucleosides or linkage | Structure |
| U | Uridine-3'-phosphate | 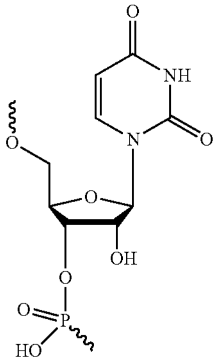 |
| fU | 2'-fluorouridine-3'-phosphate | 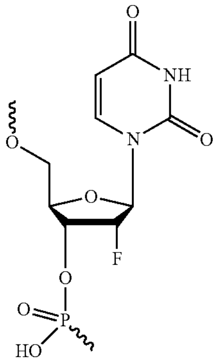 |
| fUs | 2'-fluorouridine-3'-phosphorothioate | 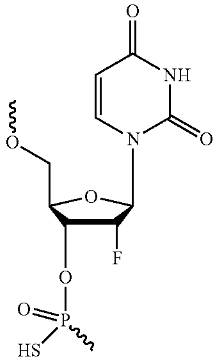 |
| mA | 2'-O-methyladenosine-3'-phosphate | 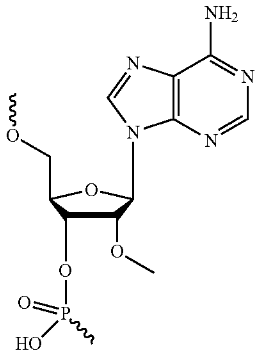 |

TABLE 3-continued
| Exemplary nucleosides with 3'-phosphate or 3'-phosphorothioate and structures | | |
|---|---|---|
| Abbreviation | Nucleosides or linkage | Structure |
| mAs | 2'-O-methyladenosine-3'-phosphorothioate | 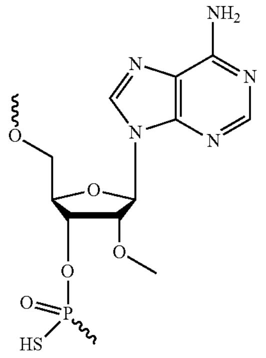 |
| mC | 2'-O-methylcytidine-3'-phosphate | 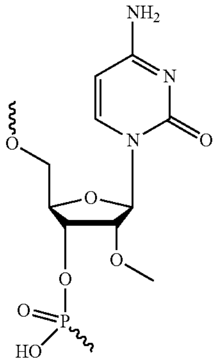 |
| mCs | 2'-O-methylcytidine-3'-phosphorothioate | 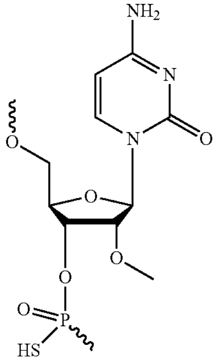 |
| mG | 2'-O-methylguanosine-3'-phosphate | 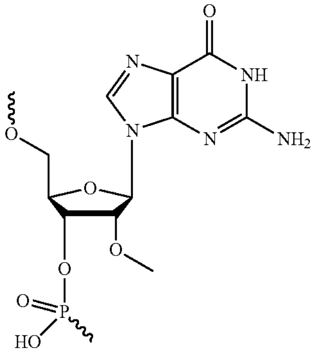 |

TABLE 3-continued
| Exemplary nucleosides with 3'-phosphate or 3'-phosphorothioate and structures | | |
|---|---|---|
| Abbreviation | Nucleosides or linkage | Structure |
| mGs | 2'-O-methylguanosine-3'-phosphorothioate | 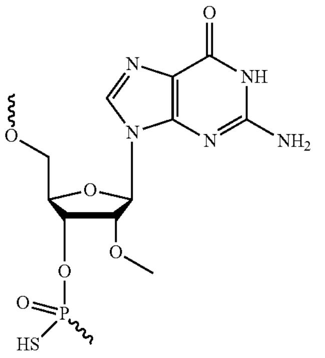 |
| mU | 2'-O-methyluridine-3'-phosphate | 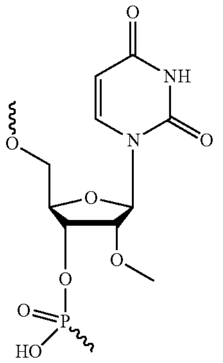 |
| mUs | 2'-O-methyluridine-3'-phosphorothioate | 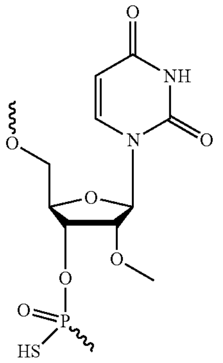 |
| | 2'-O-methoxyethyl-adenosine-3'-phosphate | 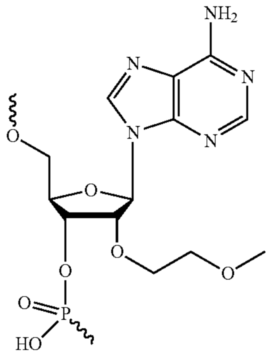 |

TABLE 3-continued
| Exemplary nucleosides with 3'-phosphate or 3'-phosphorothioate and structures | | |
|---|---|---|
| Abbreviation | Nucleosides or linkage | Structure |
| | 2'-O-methoxyethyl-adenosine-3'-phos-phorothioate | 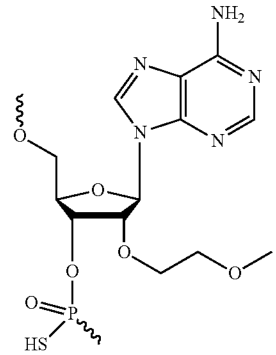 |
| | 2'-O-methoxyethyl-cytidine-3'-phosphate | 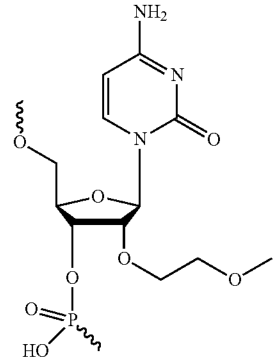 |
| | 2'-O-methoxyethyl-cytidine-3'-phosphorothioate | 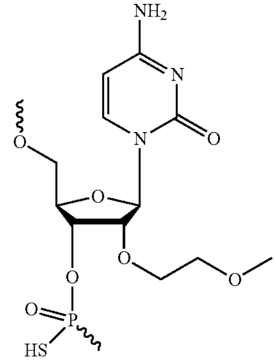 |
| | 2'-O-methoxyethyl-guanosine-3'-phosphate | 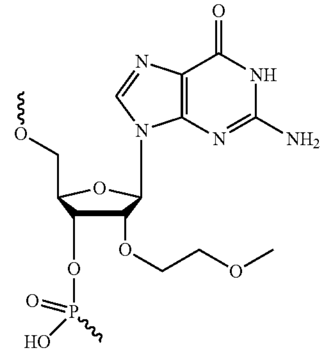 |

TABLE 3-continued

| Exemplary nucleosides with 3'-phosphate or 3'-phosphorothioate and structures | | |
|---|---|---|
| Abbreviation | Nucleosides or linkage | Structure |
| | 2'-O-methoxyethyl-guanosine-3'-phosphorothioate | 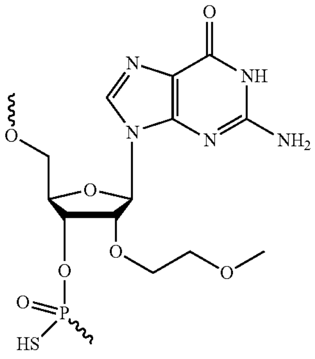 |
| | 2'-O-methoxyethyl-luridine-3'-phosphate | 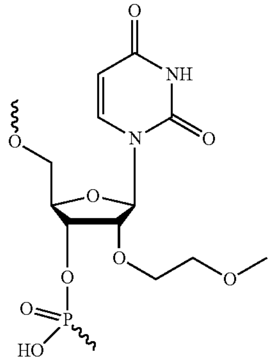 |
| | 2'-O-methoxyethyl-uridine-3'-phosphorothioate | 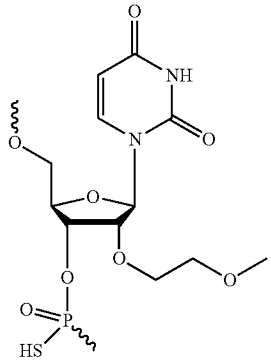 |
| s | Phosphorothioate linkage | 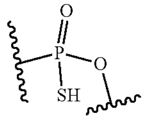 |

In some embodiments, an RNAi agent (e.g., a CYP7A1 RNAi agent described herein) comprises an antisense strand comprising one or more modified nucleosides (e.g., one or more 2'-modified nucleosides). In some embodiments, an RNAi agent (e.g., a CYP7A1 RNAi agent described herein) comprises an antisense strand comprising a mix of two or more different 2'-modified nucleosides (e.g., any combination of 2'-F modified nucleosides, 2'-O-Me modified nucleosides, and 2'-MOE modified nucleosides). In some embodiments, an RNAi agent (e.g., a CYP7A1 RNAi agent described herein) comprises a sense strand comprising one or more modified nucleosides (e.g., one or more 2'-modified nucleosides). In some embodiments, an RNAi agent (e.g., a CYP7A1 RNAi agent described herein) comprises a sense strand comprising a mix of two or more different 2'-modified nucleosides (e.g., any combination of 2'-F modified nucleosides, 2'-O-Me modified nucleosides, and 2'-MOE modified nucleosides).

In some embodiments, an RNAi agent (e.g., a CYP7A1 RNAi agent described herein) comprises an antisense strand and a sense strand, wherein each nucleoside of the antisense strand is a modified nucleoside (e.g., 2'-modified nucleoside) and each nucleoside of the sense strand is a modified nucleoside (e.g., 2'-modified nucleoside). In some embodimentsments, an RNAi agent (e.g., a CYP7A1 RNAi agent described herein) comprises an antisense strand and a sense strand, wherein each nucleoside of the antisense strand is a 2'-modified nucleoside selected from a 2'-F modified nucleoside, a 2'-O-Me modified nucleoside, and a 2'-MOE modified nucleoside, and each nucleoside of the sense strand is a 2'-modified nucleoside selected from a 2'-F modified nucleoside, a 2'-O-Me modified nucleoside, and a 2'-MOE modified nucleoside. In some embodiments, an RNAi agent (e.g., a CYP7A1 RNAi agent described herein) comprises an antisense strand and a sense strand, wherein each nucleoside of the antisense strand is a 2'-modified nucleoside selected from a 2'-F modified nucleoside and a 2'-O-Me modified nucleoside, and each nucleoside of the sense strand is a 2'-modified nucleoside selected from a 2'-F modified nucleoside and a 2'-O-Me modified nucleoside.

In some embodiments, an RNAi agent (e.g., a CYP7A1 RNAi agent described herein) comprises a sense strand and an antisense strand, wherein the nucleosides at two or more (e.g., 2, 3, 4, 5, or 6) of positions 8, 9, 10, 11, 12, and 13 (counting 5'→3') of the sense strand are nucleosides with the same 2' chemistry in the sugar moiety, e.g., unmodified (i.e., 2'-hydroxy nucleoside), 2'-F modified nucleoside, 2'-O-Me modified nucleoside, 2'-MOE modified nucleoside, or 2'-deoxy nucleoside. In some embodiments, an RNAi agent (e.g., a CYP7A1 RNAi agent described herein) comprises a sense strand and an antisense strand, wherein each of the nucleosides at positions 8-12, 8-13, 9-12, or 9-13 (counting 5'→3') of the sense strand are nucleosides with the same 2' chemistry in the sugar moiety, e.g., unmodified (i.e., 2'-hydroxy nucleoside), 2'-F modified nucleoside, 2'-O-Me modified nucleoside, 2'-MOE modified nucleoside, or 2'-deoxy nucleoside. In some embodiments, an RNAi agent (e.g., a CYP7A1 RNAi agent described herein) comprises a sense strand and an antisense strand, wherein each of the nucleosides at positions 8-12, 8-13, 9-12, or 9-13 (counting 5'→3') of the sense strand are 2'-F modified nucleosides. In some embodiments, an RNAi agent (e.g., a CYP7A1 RNAi agent described herein) comprises a sense strand and an antisense strand, wherein each of the nucleosides at positions 8-12, 8-13, 9-12, or 9-13 (counting 5'-43') of the sense strand are unmodified nucleosides (i.e., 2'-hydroxy nucleosides). The ranges referred to includes the nucleosides at both ends of the range. For example, nucleosides at positions 9-12 includes nucleosides at positions 9, 10, 11, and 12.

In some embodiments, an RNAi agent (e.g., a CYP7A1 RNAi agent described herein) comprises a sense strand and an antisense strand, wherein the nucleosides at two or more (e.g., 2, 3, 4, 5, or 6) of positions 8, 9, 10, 11, 12, and 13 (counting 5'→3') of the sense strand are consecutive nucleosides with the same 2' chemistry in the sugar moiety, e.g., unmodified nucleosides (i.e., 2'-hydroxy nucleosides), 2'-F modified nucleosides, 2'-O-Me modified nucleosides, 2'-MOE modified nucleosides, or 2'-deoxy nucleosides and the nucleosides immediately upstream and downstream to the two or more consecutive nucleosides with the same 2' chemistry in the sugar moiety are nucleosides with different 2' chemistry in the sugar moiety.

In some embodiments, an RNAi agent (e.g., a CYP7A1 RNAi agent described herein) comprises a sense strand and an antisense strand, wherein the nucleosides at positions 9, 10, 11, and 12 (counting 5'→3') of the sense strand are nucleosides with the same 2' chemistry in the sugar moiety, e.g., 2'-F modified nucleoside, 2'-O-Me modified nucleoside, 2'-MOE modified nucleoside, or 2'-deoxy nucleoside and the nucleosides at positions 8 or 13 (counting 5'→3') are nucleosides with different 2' chemistry in the sugar moiety including, e.g., unmodified nucleosides, i.e., 2'-hydroxy nucleosides. In some embodiments, an RNAi agent (e.g., a CYP7A1 RNAi agent described herein) comprises a sense strand and an antisense strand, wherein the nucleosides at positions 9, 10, 11, and 12 (counting 5'→3') of the sense strand are unmodified nucleosides, i.e., 2'-hydroxy nucleosides, and the nucleosides at positions 8 and 13 (counting 5'→3') have a different 2' chemistry in the sugar moiety, e.g., 2'-F modified nucleoside, 2'-O-Me modified nucleoside, 2'-MOE modified nucleoside, or 2'-deoxy nucleoside.

In some embodiments, an RNAi agent (e.g., a CYP7A1 RNAi agent described herein) comprises a sense strand and an antisense strand, wherein the nucleosides at positions 9, 10, 11, 12 (counting 5'3') of the sense strand are 2'-F modified nucleosides and the nucleosides at positions 8 and 13 (counting 5'→3') are not 2'-F modified nucleosides, e.g., are 2'-O-Me modified nucleosides, 2'-MOE modified nucleosides, 2'-deoxy nucleosides, or 2'-hydroxy nucleosides. In some embodiments, one or more nucleosides of the sense strand that are not 2'-F modified nucleosides are 2'-O-Me modified nucleosides. In some embodiments, all nucleosides of the sense strand that are not 2'-F modified nucleosides are 2'-O-Me modified nucleosides.

In some embodiments, an RNAi agent (e.g., a CYP7A1 RNAi agent described herein) comprises a sense strand and an antisense strand, wherein the nucleosides at one or more positions 1, 2, 3, 4, 5, 6, 7, 8 and 13, 14, 15, 16, 17, 18, 19, 20, 21 (counting 5'→3') of the sense strand are not 2'-F modified nucleosides, e.g., are 2'-O-Me modified nucleosides, 2'-MOE modified nucleosides, 2'-deoxy nucleosides, or 2'-hydroxy nucleosides. In some embodiments, an RNAi agent (e.g., a CYP7A1 RNAi agent described herein) comprises a sense strand and an antisense strand, wherein the nucleosides at one or more positions 1, 2, 3, 4, 5, 6, 7, 8 and 13, 14, 15, 16, 17, 18, 19, 20, 21 (counting 5'→3') of the sense strand are 2'-O-Me modified nucleosides.

In some embodiments, an RNAi agent (e.g., a CYP7A1 RNAi agent described herein) comprises a sense strand and an antisense strand, wherein the nucleosides at positions 1, 2, 3, 4, 5, 6, 7, 8 and 13, 14, 15, 16, 17, 18, 19, 20, 21 (counting 5'→3') of the sense strand are not 2'-F modified nucleosides, e.g., are 2'-O-Me modified nucleosides, 2'-MOE modified nucleosides, 2'-deoxy nucleosides, or 2'-hydroxy nucleosides. In some embodiments, the nucleosides at positions 1, 2, 3, 4, 5, 6, 7, 8 and 13, 14, 15, 16, 17, 18, 19, 20, 21 (counting 5'→3') of the sense strand are 2'-O-Me modified nucleosides.

In some embodiments, an RNAi agent (e.g., a CYP7A1 RNAi agent described herein) comprises a sense strand and an antisense strand, wherein the nucleosides at one or more of positions 2, 3, 5, 6, 7, 8, 10, and 14 (counting 5'→3') of the antisense strand are 2'-F modified nucleosides. In some embodiments, an RNAi agent (e.g., a CYP7A1 RNAi agent described herein) comprises a sense strand and an antisense strand, wherein the nucleosides positions 2 and 14 (counting 5'→3') of the antisense strand are 2'-F modified nucleosides. In some embodiments, an RNAi agent (e.g., a CYP7A1 RNAi agent described herein) comprises a sense strand and an antisense strand, wherein the nucleosides at positions 2, 3, 7, 10, and 14 (counting 5'→3') of the antisense strand are 2'-F modified nucleosides. In some embodiments, an RNAi agent (e.g., a CYP7A1 RNAi agent described herein) comprises a sense strand and an antisense strand, wherein the nucleosides positions at 2, 3, 7, 10, and 14 (counting 5'→3') of the antisense strand are 2'-F modified nucleosides, and one or more of positions 5, 6, and 8 (counting 5'→3') of the antisense strand are 2'-F modified nucleosides. In some embodiments, an RNAi agent (e.g., a CYP7A1 RNAi agent described herein) comprises a sense strand and an antisense strand, wherein the nucleosides at one or more of positions 2, 3, 5, 6, 7, 8, 10, and 14 (counting 5'→3') of the antisense strand are 2'-F modified nucleosides and the nucleosides at other positions are not 2'-F modified nucleosides, e.g., are 2'-O-Me modified nucleosides, 2'-MOE modified nucleosides, 2'-deoxy nucleosides, or 2'-hydroxy nucleosides. In some embodiments, an RNAi agent (e.g., a CYP7A1 RNAi agent described herein) comprises a sense strand and an antisense strand, wherein the nucleosides at one or more of positions 2, 3, 5, 6, 7, 8, 10, and 14 (counting 5'→3') of the antisense strand are 2'-F modified nucleosides and all nucleosides that are not 2'-F modified nucleosides are 2'-O-Me modified nucleosides.

In some embodiments, an RNAi agent (e.g., a CYP7A1 RNAi agent described herein) comprises a sense strand and an antisense strand, wherein the nucleosides at one or more positions 1, 4, 5, 6, 8, 9, 11, 12, 13, 15, 16, 17, 18, 19, 20, 21, 22, and 23 (counting 5'→3') of the antisense strand are not 2'-F modified nucleosides, e.g., are 2'-O-Me modified nucleosides, 2'-MOE modified nucleosides, 2'-deoxy nucleosides, or 2'-hydroxy nucleosides. In some embodiments, an RNAi agent (e.g., a CYP7A1 RNAi agent described herein) comprises a sense strand and an antisense strand, wherein the nucleosides at one or more positions 1, 4, 5, 6, 8, 9, 11, 12, 13, 15, 16, 17, 18, 19, 20, 21, 22, and 23 (counting 5'→3') of the antisense strand are 2'-O-Me modified nucleosides.

In some embodiments, an RNAi agent (e.g., a CYP7A1 RNAi agent described herein) comprises a sense strand and an antisense strand, wherein the nucleosides at positions 1, 4, 9, 11, 12, 13, 15, 16, 17, 18, 19, 20, 21, 22, and 23 (counting 5'→3') of the antisense strand are not 2'-F modified nucleosides, e.g., are 2'-O-Me modified nucleosides, 2'-MOE modified nucleosides, 2'-deoxy nucleosides, or 2'-hydroxy nucleosides. In some embodiments, an RNAi agent (e.g., a CYP7A1 RNAi agent described herein) comprises a sense strand and an antisense strand, wherein the nucleosides at positions 1, 4, 9, 11, 12, 13, 15, 16, 17, 18, 19, 20, 21, 22, and 23 (counting 5'→3') of the antisense strand are 2'-O-Me modified nucleosides.

In some embodiments, an RNAi agent (e.g., a CYP7A1 RNAi agent described herein) comprises a sense strand and an antisense strand, wherein the nucleosides at positions 2, 3, 5, 7, 8, 10, and 14 (counting 5'→3') of the antisense strand are 2'-F modified nucleosides. In some embodiments, the nucleosides at positions 1, 4, 6, 9, 11, 12, 13, 15, 16, 17, 18, 19, 20, 21, 22, and 23 (counting 5'→3') are not 2'-F modified nucleosides, e.g., are 2'-O-Me modified nucleosides, 2'-MOE modified nucleosides, 2'-deoxy nucleosides, or 2'-hydroxy nucleosides. In some embodiments, one or more nucleosides of the antisense strand that are not 2'-F modified nucleosides are 2'-O-Me modified nucleosides. In some embodiments, all nucleosides of the antisense strand that are not 2'-F modified nucleosides are 2'-O-Me modified nucleosides.

In some embodiments, an RNAi agent (e.g., a CYP7A1 RNAi agent described herein) comprises a sense strand and an antisense strand, wherein the nucleosides at positions 2, 3, 5, 6, 7, 10, and 14 (counting 5'→3') of the antisense strand are 2'-F modified nucleosides. In some embodiments, the nucleosides at positions 1, 4, 8, 9, 11, 12, 13, 15, 16, 17, 18, 19, 20, 21, 22, and 23 (counting 5'→3') are not 2'-F modified nucleosides, e.g., are 2'-O-Me modified nucleosides, 2'-MOE modified nucleosides, 2'-deoxy nucleosides, or 2'-hydroxy nucleosides. In some embodiments, one or more nucleosides of the antisense strand that are not 2'-F modified nucleosides are 2'-O-Me modified nucleosides. In some embodiments, all nucleosides of the antisense strand that are not 2'-F modified nucleosides are 2'-O-Me modified nucleosides.

In some embodiments, an RNAi agent (e.g., a CYP7A1 RNAi agent described herein) comprises a sense strand and an antisense strand, wherein the nucleosides at positions 2, 3, 5, 6, 7, 8, 10, and 14 (counting 5'→3') of the antisense strand are 2'-F modified nucleosides. In some embodiments, the nucleosides at positions 1, 4, 9, 11, 12, 13, 15, 16, 17, 18, 19, 20, 21, 22, and 23 (counting 5'→3') are not 2'-F modified nucleosides, e.g., are 2'-O-Me modified nucleosides, 2'-MOE modified nucleosides, 2'-deoxy nucleosides, or 2'-hydroxy nucleosides. In some embodiments, one or more nucleosides of the antisense strand that are not 2'-F modified nucleosides are 2'-O-Me modified nucleosides. In some embodiments, all nucleosides of the antisense strand that are not 2'-F modified nucleosides are 2'-O-Me modified nucleosides.

In some embodiments, an RNAi agent (e.g., a CYP7A1 RNAi agent described herein) comprises a sense strand and an antisense strand, wherein the nucleosides at positions 2, 3, 7, 10, and 14 (counting 5'→3') of the antisense strand are 2'-F modified nucleosides. In some embodiments, the nucleosides at positions 1, 4, 5, 6, 8, 9, 11, 12, 13, 15, 16, 17, 18, 19, 20, 21, 22, and 23 (counting 5'→3') are not 2'-F modified nucleosides, e.g., are 2'-O-Me modified nucleosides, 2'-MOE modified nucleosides, 2'-deoxy nucleosides, or 2'-hydroxy nucleosides. In some embodiments, one or more nucleosides of the antisense strand that are not 2'-F modified nucleosides are 2'-O-Me modified nucleosides. In some embodiments, all nucleosides of the antisense strand that are not 2'-F modified nucleosides are 2'-O-Me modified nucleosides.

In some embodiments, any one of the RNAi agents (e.g., CYP7A1 RNAi agents) described herein further comprises one or more (e.g., 1, 2, or 3) phosphorothioate internucleoside linkages in at least one strand. In some embodiments, any one of the RNAi agents (e.g., CYP7A1 RNAi agents) described herein further comprises one or more (e.g., 1, 2, or 3) phosphorothioate internucleoside linkages in the sense strand. In some embodiments, any one of the RNAi agents (e.g., CYP7A1 RNAi agents) described herein further comprises one or more (e.g., 1, 2, 3, 4, or 5) phosphorothioate internucleoside linkages in the antisense strand.

In some embodiments, any one of the RNAi agents (e.g., CYP7A1 RNAi agents) described herein further comprises two phosphorothioate internucleoside linkages in the sense strand and four phosphorothioate internucleoside linkages in the antisense strand. In some embodiments, any one of the RNAi agents (e.g., CYP7A1 RNAi agents) described herein further comprises two phosphorothioate internucleoside linkages in the sense strand (e.g., the first two internucleoside linkages from 5'→3') and four phosphorothioate internucleoside linkages in the antisense strand (e.g., the first two internucleoside linkages and the last two internucleoside linkages from 5'→3'). It is to be understood that, in any one of the RNAi agents (e.g., CYP7A1 RNAi agents) described herein, the rest of internucleoside linkages, unless otherwise specified, are all phosphodiester internucleoside linkages.

In some embodiments, provided is a population of two or more of the same modified RNAi agents as described herein, wherein all of the phosphorothioate internucleoside linkages are stereorandom. In some embodiments, provided is a chirally enriched population of such modified RNAi agents as described herein, wherein the chirally enriched population is enriched for modified RNAi agents comprising at least one particular phosphorothioate internucleoside linkage having a particular stereochemical configuration. In some embodiments, the chirally enriched population of modified RNAi agents is enriched for modified RNAi agents comprising at least one particular phosphorothioate internucleoside linkage having the (Sp) or (Rp) configuration. In some embodiments, the chirally enriched population of modified RNAi agents is enriched for modified RNAi agents comprising at least one particular phosphorothioate internucleoside linkage having the (Sp) configuration. In some embodiments, the chirally enriched population of modified RNAi agents is enriched for modified RNAi agents comprising at least one particular phosphorothioate internucleoside linkage having the (Rp) configuration. In some embodiments, the chirally enriched population of modified RNAi agents is enriched for modified RNAi agents having a particular, independently selected stereochemical configuration at each phosphorothioate internucleoside linkage. In some embodiments, the chirally enriched population of modified RNAi agents is enriched for modified RNAi agents having the (Rp) configuration at one particular phosphorothioate internucleoside linkage and the (Sp) configuration at each of the remaining phosphorothioate internucleoside linkages. In some embodiments, the chirally enriched population of modified RNAi agents is enriched for modified RNAi agents having the (Sp) configuration at one particular phosphorothioate internucleoside linkage and the (Rp) configuration at each of the remaining phosphorothioate internucleoside linkages. In some embodiments, the chirally enriched population of modified RNAi agents is enriched for modified RNAi agents having at least 3 contiguous phosphorothioate internucleoside linkages in the (Sp), (Sp), and (Rp) configurations, in the 5' to 3' direction. In some embodiments, the chirally enriched population of modified RNAi agents is enriched for modified RNAi agents having at least 4 contiguous phosphorothioate internucleoside linkages in the (Sp), (Sp), (Sp), and (Rp) configurations, in the 5' to 3' direction.

In some embodiments, any one of the RNAi agents (e.g., CYP7A1 RNAi agents) described herein comprises a sense strand and an antisense strand, wherein the nucleosides at positions 9, 10, 11, 12 (counting 5'→3') of the sense strand are 2'-F modified nucleosides, wherein the nucleosides at positions 2, 3, 5, 7, 8, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages. An example of such a modified RNAi agent is provided in FIG. 1—MOD 1 (“M1”).

In some embodiments, any one of the RNAi agents (e.g., CYP7A1 RNAi agents) described herein comprises a sense strand and an antisense strand, wherein the nucleosides at positions 9, 10, 11, 12 (counting 5'→3') of the sense strand are 2'-F modified nucleosides, wherein the nucleosides at positions 2, 3, 5, 6, 7, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages. An example of such a modified RNAi agent is provided in FIG. 1—MOD 2 (“M2”).

In some embodiments, any one of the RNAi agents (e.g., CYP7A1 RNAi agents) described herein comprises a sense strand and an antisense strand, wherein the nucleosides at positions 9, 10, 11, 12 (counting 5'→3') of the sense strand are 2'-F modified nucleosides, wherein the nucleosides at positions 2, 3, 5, 6, 7, 8, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages. An example of such a modified RNAi agent is provided in FIG. 1—MOD 3 (“M3”).

In some embodiments, any one of the RNAi agents (e.g., CYP7A1 RNAi agents) described herein comprises a sense strand and an antisense strand, wherein the nucleosides at positions 9, 10, 11, 12 (counting 5'→3') of the sense strand are 2'-F modified nucleosides, wherein the nucleosides at positions 2, 3, 7, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages. An example of such a modified RNAi agent is provided in FIG. 1—MOD 4 (“M4”).

In some embodiments, a CYP7A1 RNAi agent described herein comprises an antisense strand that is 18-25 nucleosides (e.g., 18, 19, 20, 21, 22, 23, 24, or 25 nucleosides) in length and comprises at least 15 (e.g., 16, 17, 18, 19, 20, 21, 22, or 23) consecutive nucleobases of any one of SEQ ID NOs: 777-1190, and a sense strand that is 18-25 nucleosides (e.g., 18, 19, 20, 21, 22, 23, 24, or 25 nucleosides) in length and comprises at least 15 (e.g., 16, 17, 18, 19, 20, 21, 22, or 23) consecutive nucleobases of any one of SEQ ID NOs: 9-776, wherein:

(i) the nucleosides at positions 9, 10, 11, 12 (counting 5'→3') of the sense strand are 2'-F modified nucleosides, wherein the nucleosides at positions 2, 3, 5, 7, 8, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages;

(ii) the nucleosides at positions 9, 10, 11, 12 (counting 5'→3') of the sense strand are 2'-F modified nucleosides, wherein the nucleosides at positions 2, 3, 5, 6, 7, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages;

(iii) the nucleosides at positions 9, 10, 11, 12 (counting 5'→3') of the sense strand are 2'-F modified nucleosides, wherein the nucleosides at positions 2, 3, 5, 6, 7, 8, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages; or (iv) the nucleosides at positions 9, 10, 11, 12 (counting 5'→3') of the sense strand are 2'-F modified nucleosides, wherein the nucleosides at positions 2, 3, 7, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages.

In some embodiments, a CYP7A1 RNAi agent described herein comprises an antisense strand that comprises the nucleobase sequence of any one of SEQ ID NOs: 777-1190 and further comprises a sense strand that is substantially complementary to the antisense strand and comprises the nucleobase sequence of any one of SEQ ID NOs: 393-776, wherein the nucleosides at positions 9, 10, 11, 12 (counting 5'→3') of the sense strand are 2'-F modified nucleosides, wherein the nucleosides at positions 2, 3, 5, 7, 8, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages.

In some embodiments, a CYP7A1 RNAi agent described herein comprises an antisense strand that comprises the nucleobase sequence of any one of SEQ ID NOs: 777-1190, and further comprises a sense strand that is substantially complementary to the antisense strand and comprises the nucleobase sequence of any one of SEQ ID NOs: 393-776, wherein the nucleosides at positions 9, 10, 11, 12 (counting 5'→3') of the sense strand are 2'-F modified nucleosides, wherein the nucleosides at positions 2, 3, 5, 6, 7, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages.

In some embodiments, a CYP7A1 RNAi agent described herein comprises an antisense strand that comprises the nucleobase sequence of any one of SEQ ID NOs: 777-1190, and further comprises a sense strand that is substantially complementary to the antisense strand and comprises the nucleobase sequence of any one of SEQ ID NOs: 393-776, wherein the nucleosides at positions 9, 10, 11, 12 (counting 5'→3') of the sense strand are 2'-F modified nucleosides, wherein the nucleosides at positions 2, 3, 5, 6, 7, 8, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages.

In some embodiments, a CYP7A1 RNAi agent described herein comprises an antisense strand that comprises the nucleobase sequence of any one of SEQ ID NOs: 777-1190, and further comprises a sense strand that is substantially complementary to the antisense strand and comprises the nucleobase sequence of any one of SEQ ID NOs: 393-776, wherein the nucleosides at positions 9, 10, 11, 12 (counting 5'→3') of the sense strand are 2'-F modified nucleosides, wherein the nucleosides at positions 2, 3, 7, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages.

In some embodiments, a CYP7A1 RNAi agent described herein comprises an antisense strand that comprises the nucleobase sequence of any one of SEQ ID NOs: 1161-1190 and further comprises a sense strand that is substantially complementary to the antisense strand and comprises the nucleobase sequence of any one of SEQ ID NOs: 404, 419, 430, 439, 443, 464, 465, 473, 492, 493, 510, 514, 516, 517, 550, 553, 564, 566, 582, 591, 595, 597, 598, 604, 618, 623, 642, 648, 652, and 664, wherein the nucleosides at positions 9, 10, 11, 12 (counting 5'→3') of the sense strand are 2'-F modified nucleosides, wherein the nucleosides at positions 2, 3, 5, 6, 7, 8, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages.

In some embodiments, a CYP7A1 RNAi agent described herein comprises an antisense strand that comprises the nucleobase sequence of any one of SEQ ID NOs: 1161, 1162, 1165, 1166, 1169, 1173, 1174, 1180, 1181, 1184, 1188, and 1190 and further comprises a sense strand that is substantially complementary to the antisense strand and comprises the nucleobase sequence of any one of SEQ ID NOs: 404, 419, 439, 443, 464, 473, 493, 517, 566, 597, 598, 604, wherein the nucleosides at positions 9, 10, 11, 12 (counting 5'→3') of the sense strand are 2'-F modified nucleosides, wherein the nucleosides at positions 2, 3, 5, 7, 8, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages.

In some embodiments, a CYP7A1 RNAi agent described herein comprises an antisense strand that comprises the nucleobase sequence of any one of SEQ ID NOs: 1161, 1162, 1165, 1166, 1169, 1173, 1174, 1180, 1181, 1184, 1188, and 1190 and further comprises a sense strand that is substantially complementary to the antisense strand and comprises the nucleobase sequence of any one of SEQ ID NOs: 404, 419, 439, 443, 464, 473, 493, 517, 566, 597, 598, 604, wherein the nucleosides at positions 9, 10, 11, 12 (counting 5'→3') of the sense strand are 2'-F modified nucleosides, wherein the nucleosides at positions 2, 3, 5, 6, 7, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages.

In some embodiments, a CYP7A1 RNAi agent described herein comprises an antisense strand that comprises the nucleobase sequence of any one of SEQ ID NOs: 1161, 1162, 1165, 1166, 1169, 1173, 1174, 1180, 1181, 1184, 1188, and 1190 and further comprises a sense strand that is substantially complementary to the antisense strand and comprises the nucleobase sequence of any one of SEQ ID NOs: 404, 419, 439, 443, 464, 473, 493, 517, 566, 597, 598, 604, wherein the nucleosides at positions 9, 10, 11, 12 (counting 5'→3') of the sense strand are 2'-F modified nucleosides, wherein the nucleosides at positions 2, 3, 5, 6, 7, 8, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages.

In some embodiments, a CYP7A1 RNAi agent described herein comprises an antisense strand that comprises the nucleobase sequence of any one of SEQ ID NOs: 1161, 1162, 1165, 1166, 1169, 1173, 1174, 1180, 1181, 1184, 1188, and 1190 and further comprises a sense strand that is substantially complementary to the antisense strand and comprises the nucleobase sequence of any one of SEQ ID NOs: 404, 419, 439, 443, 464, 473, 493, 517, 566, 597, 598, 604, wherein the nucleosides at positions 9, 10, 11, 12 (counting 5'→3') of the sense strand are 2'-F modified nucleosides, wherein the nucleosides at positions 2, 3, 7, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages.

In some embodiments, a CYP7A1 RNAi agent described herein comprises: a sense strand comprising the nucleobase sequence of SEQ ID NO: 419 and a structure of (5'→3')

[mUs][mCs][mU][mU][mG][mA][mG][mU][fU][fC][fC][fU][mC][mA][mG][mA][mG][mC][mA][mA][mAs] (SEQ ID NO: 1219), and an antisense strand comprising the nucleobase sequence of SEQ ID NO: 1161 and a structure of (5'→3'):

(i)

(SEQ ID NO: 1989)

[[mUs]][[fUs]][[fU]][[mG]][[fC]][[fU]][[fC]][[fU]][[mG]][[fA]][[mG]][[mG]][[mA]][[fA]][[mC]][[mU]][[mC]][[mA]][[mA]][[mG]][[mAs]][[mAs]][[mG]];

(ii)

(SEQ ID NO: 1990)

[[mUs]][[fUs]][[fU]][[mG]][[mC]][[mU]][[fC]][[mU]][[mG]][[fA]][[mG]][[mG]][[mA]][[fA]][[mC]][[mU]][[mC]][[mA]][[mA]][[mG]][[mAs]][[mAs]][[mG]];

(iii)

(SEQ ID NO: 1991)

[[mUs]][[fUs]][[fU]][[mG]][[fC]][[mU]][[fC]][[fU]][[mG]][[fA]][[mG]][[mG]][[mA]][[fA]][[mC]][[mU]][[mC]][[mA]][[mA]][[mG]][[mAs]][[mAs]][[mG]];

or (iv)

(SEQ ID NO: 1992)

[[mUs]][[fUs]][[fU]][[mG]][[fC]][[fU]][[fC]][[mU]][[mG]][[fA]][[mG]][[mG]][[mA]][[fA]][[mC]][[mU]][[mC]][[mA]][[mA]][[mG]][[mAs]][[mAs]][[mG]]

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage. It is to be understood that the "s" of the 3'-terminal [mAs] of the sense strand indicates a phosphorothioate linkage between the 3'-terminal nucleoside of the sense strand and a conjugated moiety (e.g., a targeting moiety described herein). In some embodiments, the "s" of the 3'-terminal [mAs] of the sense strand corresponds to the phosphorothioate linkage (e.g.,

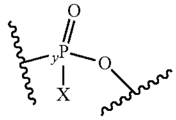, wherein X is —SH, i.e.,

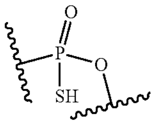)

of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formulae: (I), (I-a), (I-a-1), (I-b), (I-b-1), (I-c), (I-c-1), (I-d), (I-d-1), (I-e), (I-e-1), (I-f), (I-f-1), (I-g), (I-h), (I-i), (I-j), (II), (II-a), (Ib-b), (II-c), (III), (III-a), (IV), (IV-a), (IV-b), (IV-c), (IV-d), (IV-e), (IV-f), or $(Z^1)$-$(Z^{16})$.

In some embodiments, a CYP7A1 RNAi agent described herein comprises: a sense strand comprising the nucleobase sequence of SEQ ID NO: 517 and a structure of (5'→3')

[mGs][mCs][mG][mC][mA][mU][mG][mU][fU][fU][fC][fU][mC][mA][mA][mU][mG][mA][mC][mA][mAs] (SEQ ID NO: 1329), and an antisense strand comprising the nucleobase sequence of SEQ ID NO: 1162 and a structure of (5'→3'):

(i)
(SEQ ID NO: 1993)
[[mUs]][[fUs]][[fG]][[mU]][[fC]][[fA]][[fU]][[fU]][[mG]][[fA]][[mG]]
[[mA]][[mA]][[fA]][[mC]][[mA]][[mU]][[mG]][[mC]][[mG]][[mCs]][[mAs]]
[[mG]];

(ii)
(SEQ ID NO: 1994)
[[mUs]][[fUs]][[fG]][[mU]][[mC]][[mA]][[fU]][[mU]][[mG]][[fA]][[mG]]
[[mA]][[mA]][[fA]][[mC]][[mA]][[mU]][[mG]][[mC]][[mG]][[mCs]][[mAs]]
[[mG]];

(iii)
(SEQ ID NO: 1995)
[[mUs]][[fUs]][[fG]][[mU]][[fC]][[mA]][[fU]][[fU]][[mG]][[fA]][[mG]]
[[mA]][[mA]][[fA]][[mC]][[mA]][[mU]][[mG]][[mC]][[mG]][[mCs]][[mAs]]
[[mG]];
or (iv)
(SEQ ID NO: 1996)
[[mUs]][[fUs]][[fG]][[mU]][[fC]][[fA]][[fU]][[mU]][[mG]][[fA]][[mG]]
[[mA]][[mA]][[fA]][[mC]][[mA]][[mU]][[mG]][[mC]][[mG]][[mCs]][[mAs]]
[[mG]];

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage. It is to be understood that the "s" of the 3'-terminal [mAs] of the sense strand indicates a phosphorothioate linkage between the 3'-terminal nucleoside of the sense strand and a conjugated moiety (e.g., a targeting moiety described herein). In some embodiments, the "s" of the 3'-terminal [mAs] of the sense strand corresponds to the phosphorothioate linkage (e.g.,

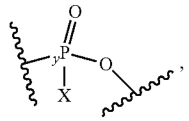

wherein X is —SH, i.e.,

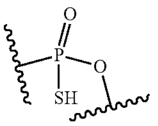

)

of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formulae: (I), (I-a), (I-a-1), (I-b), (I-b-1), (I-c), (I-c-1), (I-d), (I-d-1), (I-e), (I-e-1), (I-f), (I-f-1), (I-g), (I-h), (I-i), (I-j), (II), (II-a), (II-b), (II-c), (III), (III-a), (IV), (IV-a), (IV-b), (IV-c), (IV-d), (IV-e), (IV-f), or $(Z^1)$-$(Z^{16})$.

In some embodiments, a CYP7A1 RNAi agent described herein comprises: a sense strand comprising the nucleobase sequence of SEQ ID NO: 597 and a structure of (5'→3')

[mUs][mAs][mG][mC][mU][mC][mU][mU][fU][fA][fC][fC][mC][mA][mC][mA][mG][mU][mU][mA][mAs] (SEQ ID NO: 1417), and an antisense strand comprising the nucleobase sequence of SEQ ID NO: 1165 and a structure of (5'→3'):

(i)
(SEQ ID NO: 1999)
[[mUs]][[fUs]][[fA]][[mA]][[fC]][[fU]][[fG]][[fU]][[mG]][[fG]][[mG]]
[[mU]][[mA]][[fA]][[mA]][[mG]][[mA]][[mG]][[mC]][[mU]][[mAs]][[mAs]]
[[mG]];

(ii)
(SEQ ID NO: 2000)
[[mUs]][[fUs]][[fA]][[mA]][[mC]][[mU]][[fG]][[mU]][[mG]][[fG]][[mG]]
[[mU]][[mA]][[fA]][[mA]][[mG]][[mA]][[mG]][[mC]][[mU]][[mAs]][[mAs]]
[[mG]];

(iii)
(SEQ ID NO: 2001)
[[mUs]][[fUs]][[fA]][[mA]][[fC]][[mU]][[fG]][[fU]][[mG]][[fG]][[mG]]
[[mU]][[mA]][[fA]][[mA]][[mG]][[mA]][[mG]][[mC]][[mU]][[mAs]][[mAs]]
[[mG]];
or (iv)
(SEQ ID NO: 2002)
[[mUs]][[fUs]][[fA]][[mA]][[fC]][[fU]][[fG]][[mU]][[mG]][[fG]][[mG]]
[[mU]][[mA]][[fA]][[mA]][[mG]][[mA]][[mG]][[mC]][[mU]][[mAs]][[mAs]]
[[mG]];

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage. It is to be understood that the "s" of the 3'-terminal [mAs] of the sense strand indicates a phosphorothioate linkage between the 3'-terminal nucleoside of the sense strand and a conjugated moiety (e.g., a targeting moiety described herein). In some embodiments, the "s" of the 3'-terminal [mAs] of the sense strand corresponds to the phosphorothioate linkage (e.g.,

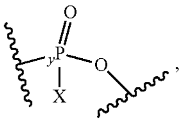

wherein X is —SH, i.e.,

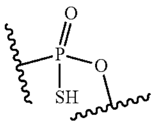

)

of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formulae: (I), (I-a), (I-a-1), (I-b), (I-b-1), (I-c), (I-c-1), (I-d), (I-d-1), (I-e), (I-e-1), (I-f), (I-f-1), (I-g), (I-h), (I-i), (I-j), (II, (II-a), (II-b), (II-c), (III), (III-a), (IV), (IV-a), (IV-b), (IV-c), (IV-d), (IV-e), (IV-f), or $(Z^1)$-$(Z^{16})$.

In some embodiments, a CYP7A1 RNAi agent described herein comprises: a sense strand comprising the nucleobase sequence of SEQ ID NO: 566 and a structure of (5' →3')

[mAs][mCs][mU][mG][mA][mA][mU][mG][fA][fC][fC][fU][mG][mC][mC][mA][mG][mU][mA][mU][mAs] (SEQ ID NO: 1382), and an antisense strand comprising the nucleobase sequence of SEQ ID NO: 1166 and a structure of (5'→3'):

(i)
(SEQ ID NO: 2003)
[mUs][fAs][fU][mA][fC][fU][fG][fG][mC][fA][mG][mG][mU][fC][mA][mU][mU][mC][mA][mG][mUs][mAs][mG];

(ii)
(SEQ ID NO: 2004)
[mUs][fAs][fU][mA][mC][mU][fG][mG][mC][fA][mG][mG][mU][fC][mA][mU][mU][mC][mA][mG][mUs][mAs][mG];

(iii)
(SEQ ID NO: 2005)
[mUs][fAs][fU][mA][fC][mU][fG][fG][mC][fA][mG][mG][mU][fC][mA][mU][mU][mC][mA][mG][mUs][mAs][mG];
or (iv)
(SEQ ID NO: 2006)
[mUs][fAs][fU][mA][fC][fU][fG][mG][mC][fA][mG][mG][mU][fC][mA][mU][mU][mC][mA][mG][mUs][mAs][mG];

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage. It is to be understood that the "s" of the 3'-terminal [mAs] of the sense strand indicates a phosphorothioate linkage between the 3'-terminal nucleoside of the sense strand and a conjugated moiety (e.g., a targeting moiety described herein). In some embodiments, the "s" of the 3'-terminal [mAs] of the sense strand corresponds to the phosphorothioate linkage (e.g.,

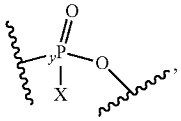

wherein X is —SH, i.e.,

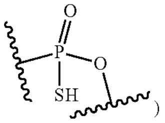

of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formulae: (I), (I-a), (I-a-1), (I-b), (I-b-1), (I-c), (I-c-1), (I-d), (I-d-1), (I-e), (I-e-1), (I-f), (I-f-1), (I-g), (I-h), (I-i), (I-j), (II), (II-a), (II-b), (II-c), (III), (III-a), (IV), (IV-a), (IV-b), (IV-c), (IV-d), (IV-e), (IV-f), or $(Z^1)$-$(Z^{16})$.

In some embodiments, a CYP7A1 RNAi agent described herein comprises: a sense strand comprising the nucleobase sequence of SEQ ID NO: 439 and a structure of (5'→3')

[mUs][mGs][mU][mC][mC][mA][mU][mU][fU][fC][fA][fU][mC][mA][mC][mA][mA][mA][mU][mC][mAs] (SEQ ID NO: 1241), and an antisense strand comprising the nucleobase sequence of SEQ ID NO: 1169 and a structure of (5'→3'):

(i)
(SEQ ID NO: 2009)
[mUs][fGs][fA][mU][fU][fU][fG][fU][mG][fA][mU][mG][mA][fA][mA][mU][mG][mG][mA][mC][mAs][mAs][mG];

(ii)
(SEQ ID NO: 2010)
[mUs][fGs][fA][mU][mU][mU][fG][mU][mG][fA][mU][mG][mA][fA][mA][mU][mG][mG][mA][mC][mAs][mAs][mG];

(iii)
(SEQ ID NO: 2011)
[mUs][fGs][fA][mU][fU][mU][fG][fU][mG][fA][mU][mG][mA][fA][mA][mU][mG][mG][mA][mC][mAs][mAs][mG];
or (iv)
(SEQ ID NO: 2012)
[mUs][fGs][fA][mU][fU][fU][fG][mU][mG][fA][mU][mG][mA][fA][mA][mU][mG][mG][mA][mC][mAs][mAs][mG];

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage. It is to be understood that the "s" of the 3'-terminal [mAs] of the sense strand indicates a phosphorothioate linkage between the 3'-terminal nucleoside of the sense strand and a conjugated moiety (e.g., a targeting moiety described herein). In some embodiments, the "s" of the 3'-terminal [mAs] of the sense strand corresponds to the phosphorothioate linkage (e.g.,

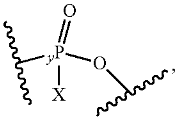

wherein X is —SH, i.e.,

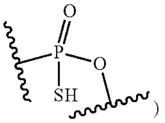

of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formulae: (I), (I-a), (I-a-1), (I-b), (I-b-1), (I-c), (I-c-1), (I-d), (1-d-1), (I-e), (I-e-1), (I-f), (I-f-1), (I-g), (I-h), (I-i), (I-j), (II), (II-a), (II-b), (II-c), (III), (III-a), (IV), (IV-a), (IV-b), (IV-c), (IV-d), (IV-e), (IV-f), or $(Z^1)$-$(Z^{16})$.

In some embodiments, a CYP7A1 RNAi agent described herein comprises:

a sense strand comprising the nucleobase sequence of SEQ ID NO: 604 and a structure of (5'→3')

[mCs][mCs][mC][mA][mC][mA][mG][mU][fU][fA][fA][fU][mG][mC][mA][mC][mU][mU][mA][mG][mAs] (SEQ ID NO: 1425), and an antisense strand comprising the nucleobase sequence of SEQ ID NO: 1173 and a structure of (5'→3'):

(i)
(SEQ ID NO: 2017)
[mUs][fCs][fU][mA][fA][fG][fU][fG][mC][fA][mU][mU][mA][fA][mC][mU][mG][mU][mG][mG][mGs][mAs][mG];

(ii)
(SEQ ID NO: 2018)
[mUs][fCs][fU][mA][mA][mG][fU][mG][mC][fA][mU][mU][mA][fA][mC][mU][mG][mU][mG][mG][mGs][mAs][mG];

(iii)
(SEQ ID NO: 2016)
[mUs][fCs][fU][mA][fA][mG][fU][fG][mC][fA][mU][mU][mA][fA][mC][mU][mG][mU][mG][mG][mGs][mAs][mG];
or (iv)
(SEQ ID NO: 2019)
[mUs][fCs][fU][mA][fA][fG][fU][mG][mC][fA][mU][mU][mA][fA][mC][mU][mG][mU][mG][mG][mGs][mAs][mG];

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage. It is to be understood that the "s" of the 3'-terminal [mAs] of the sense strand indicates a phosphorothioate linkage between the 3'-terminal nucleoside of the sense strand and a conjugated moiety (e.g., a targeting moiety described herein). In some embodiments, the "s" of the 3'-terminal [mAs] of the sense strand corresponds to the phosphorothioate linkage (e.g.,

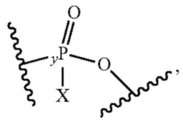

wherein X is —SH, i.e.,

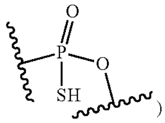

)

of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formulae: (I), (I-a), (I-a-1), (I-b), (I-b-1), (I-c), (I-c-1), (I-d), (I-d-1), (I-e), (I-e-1), (I-f), (I-f-1), (I-g), (I-h), (I-i), (I-j), (II), (II-a), (II-b), (II-c), (III), (III-a), (IV), (IV-a), (IV-b), (IV-c), (IV-d), (IV-e), (IV-f), or $(Z^1)$-$(Z^{16})$.

In some embodiments, a CYP7A1 RNAi agent described herein comprises: a sense strand comprising the nucleobase sequence of SEQ ID NO: 598 and a structure of (5'→3')

[mAs][mGs][mC][mU][mC][mU][mU][mU][fA][fC][fC][fC][mA][mC][mA][mG][mU][mU][mA][mA][mAs] (SEQ ID NO: 1418), and an antisense strand comprising the nucleobase sequence of SEQ ID NO: 1174 and a structure of (5'→3'):

(i)
(SEQ ID NO: 2021)
[mUs][fUs][fU][mA][fA][fC][fU][fG][mU][fG][mG][mG][mU][fA][mA][mA][mG][mA][mG][mC][mUs][mAs][mG];

(ii)
(SEQ ID NO: 2018)
[mUs][fCs][fU][mA][mA][mG][fU][mG][mC][fA][mU][mU][mA][fA][mC][mU][mG][mU][mG][mG][mGs][mAs][mG];

(iii)
(SEQ ID NO: 2020)
[mUs][fUs][fU][mA][fA][mC][fU][fG][mU][fG][mG][mG][mU][fA][mA][mA][mG][mA][mG][mC][mUs][mAs][mG];
or (iv)
(SEQ ID NO: 2023)
[mUs][fUs][fU][mA][fA][fC][fU][mG][mU][fG][mG][mG][mU][fA][mA][mA][mG][mA][mG][mC][mUs][mAs][mG];

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage. It is to be understood that the "s" of the 3'-terminal [mAs] of the sense strand indicates a phosphorothioate linkage between the 3'-terminal nucleoside of the sense strand and a conjugated moiety (e.g., a targeting moiety described herein). In some embodiments, the "s" of the 3'-terminal [mAs] of the sense strand corresponds to the phosphorothioate linkage (e.g.,

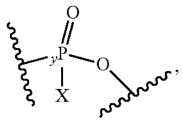

wherein X is —SH, i.e.,

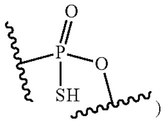

)

of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formulae: (I), (I-a), (I-a-1), (I-b), (I-b-1), (I-c), (I-c-1), (I-d), (I-d-1), (I-e), (I-e-1), (I-f), (I-f-1), (I-g), (I-h), (I-i), (I-j), (II), (II-a), (II-b), (II-c), (III), (III-a), (IV), (IV-a), (IV-b), (IV-c), (IV-d), (IV-e), (IV-f), or $(Z^1)$-$(Z^{16})$.

In some embodiments, a CYP7A1 RNAi agent described herein comprises: a sense strand comprising the nucleobase sequence of SEQ ID NO: 404 and a structure of (5'→3')

[mUs][mUs][mG][mU][mC][mU][mA][mU][fG][fG][fC][fU][mU][mA][mU][mU][mC][mU][mU][mG][mAs] (SEQ ID NO: 1202), and an antisense strand comprising the nucleobase sequence of SEQ ID NO: 1180 and a structure of (5'→3'):

(i)
(SEQ ID NO: 2029)
[mUs][fCs][fA][mA][fG][fA][fA][fU][mA][fA][mG][mC][mC][fA][mU][mA][mG][mA][mC][mA][mAs][mAs][mG];

(ii)
(SEQ ID NO: 2030)
[mUs][fCs][fA][mA][mG][mA][fA][mU][mA][fA][mG][mC][mC][fA][mU][mA][mG][mA][mC][mA][mAs][mAs][mG];

(iii)
(SEQ ID NO: 2031)
[mUs][fCs][fA][mA][fG][mA][fA][fU][mA][fA][mG][mC][mC][fA][mU][mA][mG][mA][mC][mA][mAs][mAs][mG];
or (iv)
(SEQ ID NO: 2032)
[mUs][fCs][fA][mA][fG][fA][fA][mU][mA][fA][mG][mC][mC][fA][mU][mA][mG][mA][mC][mA][mAs][mAs][mG];

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage. It is to be understood that the "s" of the 3'-terminal [mAs] of the sense strand indicates a phosphorothioate linkage between the 3'-terminal nucleoside of the sense strand and a conjugated moiety (e.g., a targeting moiety described herein). In some embodiments, the "s" of the 3'-terminal [mAs] of the sense strand corresponds to the phosphorothioate linkage (e.g.,

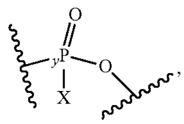
, wherein X is —SH, i.e.,

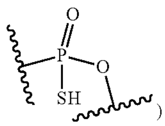
)

of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formulae: (I), (I-a), (I-a-1), (I-b), (I-b-1), (I-c), (I-c-1), (I-d), (I-d-1), (I-e), (I-e-1), (I-f), (I-f-1), (I-g), (I-h), (I-i), (I-j), (II), (II-a), (1-b), (II-c), (III), (III-a), (IV), (IV-a), (IV-b), (IV-c), (IV-d), (IV-e), (IV-f), or $(Z^1)$-$(Z^{16})$.

In some embodiments, a CYP7A1 RNAi agent described herein comprises: a sense strand comprising the nucleobase sequence of SEQ ID NO: 464 and a structure of (5'→3')

[mCs][mCs][mU][mU][mG][mA][mA][mU][fU][fC][fC][fC][mU][mC][mA][mC][mG][mG][mA][mA][mAs] (SEQ ID NO: 1267), and an antisense strand comprising the nucleobase sequence of SEQ ID NO: 1181 and a structure of (5'→3'):

(i)
(SEQ ID NO: 2034)
[mUs][fUs][fU][mC][fC][fG][fU][fG][mA][fG][mG][mG][mA][fA][mU][mU][mC][mA][mA][mG][mGs][mAs][mG];

(ii)
(SEQ ID NO: 2035)
[mUs][fUs][fU][mC][mC][mG][fU][mG][mA][fG][mG][mG][mA][fA][mU] [mU][mC][mA][mA][mG][mGs][mAs][mG];

iii)
(SEQ ID NO: 2036)
[mUs][fUs][fU][mC][fC][mG][fU][fG][mA][fG][mG][mG][mA][fA][mU][mU][mC][mA][mA][mG][mGs][mAs][mG];
or (iv)
(SEQ ID NO: 2033)
[mUs][fUs][fU][mC][fC][fG][fU][mG][mA][fG][mG][mG][mA][fA][mU][mU][mC][mA][mA][mG][mGs][mAs][mG];

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage. It is to be understood that the "s" of the 3'-terminal [mAs] of the sense strand indicates a phosphorothioate linkage between the 3'-terminal nucleoside of the sense strand and a conjugated moiety (e.g., a targeting moiety described herein). In some embodiments, the "s" of the 3'-terminal [mAs] of the sense strand corresponds to the phosphorothioate linkage (e.g.,

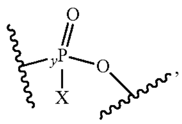
, wherein X is —SH, i.e.,

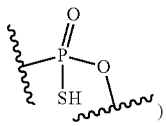
)

of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formulae: (I), (I-a), (I-a-1), (I-b), (I-b-1), (I-c), (I-c-1), (I-d), (I-d-1), (I-e), (I-e-1), (I-f), (I-f-1), (I-g), (I-h), (I-i), (I-j), (II), (II-a), (II-b), (II-c), (III), (III-a), (IV), (IV-a), (IV-b), (IV-c), (IV-d), (IV-e), (IV-f), or $(Z^1)$-$(Z^{16})$.

In some embodiments, a CYP7A1 RNAi agent described herein comprises: a sense strand comprising the nucleobase sequence of SEQ ID NO: 443 and a structure of (5'→3')

[mUs][mCs][mA][mC][mA][mA][mA][mU][fC][fC][fC][fU][mU][mG][mU][mC][mA][mU][mA][mC][mAs] (SEQ ID NO: 1246), and an antisense strand comprising the nucleobase sequence of SEQ ID NO: 1184 and a structure of (5'→3'):

(i) (SEQ ID NO: 2039)
[mUs][fGs][fU][mA][fU][fG][fA][fC][mA][fA][mG]
[mG][mG][fA][mU][mU][mU][mG][mU][mG][mAs][mAs]
[mG];

(ii) (SEQ ID NO: 2040)
[mUs][fGs][fU][mA][mU][mG][fA][mC][mA][fA][mG]
[mG][mG][fA][mU][mU][mU][mG][mU][mG][mAs][mAs]
[mG];

(iii) (SEQ ID NO: 2041)
[mUs][fGs][fU][mA][fU][mG][fA][fC][mA][fA][mG]
[mG][mG][fA][mU][mU][mU][mG][mU][mG][mAs][mAs]
[mG];
or (iv) (SEQ ID NO: 2042)
[mUs][fGs][fU][mA][fU][fG][fA][mC][mA][fA][mG]
[mG][mG][fA][mU][mU][mU][mG][mU][mG][mAs][mAs]
[mG];

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage. It is to be understood that the "s" of the 3'-terminal [mAs] of the sense strand indicates a phosphorothioate linkage between the 3'-terminal nucleoside of the sense strand and a conjugated moiety (e.g., a targeting moiety described herein). In some embodiments, the "s" of the 3'-terminal [mAs] of the sense strand corresponds to the phosphorothioate linkage (e.g.,

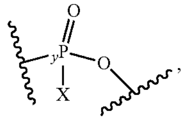, wherein X is —SH, i.e.,

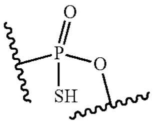)

of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formulae: (I), (I-a), (I-a-1), (I-b), (I-b-1), (I-c), (I-c-1), (I-d), (I-d-1), (I-e), (I-e-1), (I-f), (I-f-1), (I-g), (I-h), (I-i), (I-j), (II), (II-a), (II-b), (II-c), (III), (III-a), (IV), (IV-a), (IV-b), (IV-c), (IV-d), (IV-e), (IV-f), or $(Z^1)$-$(Z^{16})$.

In some embodiments, a CYP7A1 RNAi agent described herein comprises: a sense strand comprising the nucleobase sequence of SEQ ID NO: 493 and a structure of (5'→3')

[mAs][mUs][mG][mU][mU][mU][mG][mA][fA][fG][fC][fU][mG][mG][mG][mU][mA][mU][mU][mU][mAs] (SEQ ID NO: 1301), and an antisense strand comprising the nucleobase sequence of SEQ ID NO: 1188 and a structure of (5'→3'):

(i) (SEQ ID NO: 2046)
[mUs][fAs][fA][mA][fU][fA][fC][fC][mC][fA][mG]
[mC][mU][fU][mC][mA][mA][mA][mC][mA][mUs][mAs]
[mG];

(ii) (SEQ ID NO: 2047)
[mUs][fAs][fA][mA][mU][mA][fC][mC][mC][fA][mG]
[mC][mU][fU][mC][mA][mA][mA][mC][mA][mUs][mAs]
[mG];

(iii) (SEQ ID NO: 2048)
[mUs][fAs][fA][mA][fU][mA][fC][fC][mC][fA][mG]
[mC][mU][fU][mC][mA][mA][mA][mC][mA][mUs][mAs]
[mG];
or (iv) (SEQ ID NO: 2049)
[mUs][fAs][fA][mA][fU][fA][fC][mC][mC][fA][mG]
[mC][mU][fU][mC][mA][mA][mA][mC][mA][mUs][mAs]
[mG];

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage. It is to be understood that the "s" of the 3'-terminal [mAs] of the sense strand indicates a phosphorothioate linkage between the 3'-terminal nucleoside of the sense strand and a conjugated moiety (e.g., a targeting moiety described herein). In some embodiments, the "s" of the 3'-terminal [mAs] of the sense strand corresponds to the phosphorothioate linkage (e.g.,

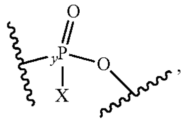, wherein X is —SH, i.e.,

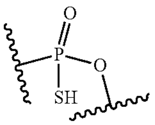)

of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formulae: (I), (I-a), (I-a-1), (I-b), (I-b-1), (I-c), (I-c-1), (I-d), (I-d-1), (I-e), (I-e-1), (I-f), (I-f-1), (I-g), (I-h), (I-i), (I-j), (II), (II-a), (II-b), (II-c), (III), (III-a), (IV), (IV-a), (IV-b), (IV-c), (IV-d), (IV-e), (IV-f), or $(Z^1)$-$(Z^{16})$.

In some embodiments, a CYP7A1 RNAi agent described herein comprises: a sense strand comprising the nucleobase sequence of SEQ ID NO: 473 and a structure of (5'→3')

[mGs][mAs][mA][mA][mA][mC][mC][mU][fC][fC][fA][fA][mC][mG][mU][mA][mU][mC][mA][mU][mAs] (SEQ ID NO: 1279), and an antisense strand comprising the nucleobase sequence of SEQ ID NO: 1190 and a structure of (5'→3'):

(i) (SEQ ID NO: 2051)
[mUs][fAs][fU][mG][fA][fU][fA][fC][mG][fU][mU]
[mG][mG][fA][mG][mG][mU][mU][mU][mU][mCs][mAs]
[mG];

(ii) (SEQ ID NO: 2052)
[mUs][fAs][fU][mG][mA][mU][fA][mC][mG][fU][mU]
[mG][mG][fA][mG][mG][mU][mU][mU][mU][mCs][mAs]
[mG];

(iii) (SEQ ID NO: 2053)
[mUs][fAs][fU][mG][fA][mU][fA][fC][mG][fU][mU]
[mG][mG][fA][mG][mG][mU][mU][mU][mU][mCs][mAs]
[mG];
or (iv) (SEQ ID NO: 2054)
[mUs][fAs][fU][mG][fA][fU][fA][mC][mG][fU][mU]
[mG][mG][fA][mG][mG][mU][mU][mU][mU][mCs][mAs]
[mG];

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage. It is to be understood that the "s" of the 3'-terminal [mAs] of the sense strand indicates a phosphorothioate linkage between the 3'-terminal nucleoside of the sense strand and a conjugated moiety (e.g., a targeting moiety described herein). In some embodiments, the "s" of the 3'-terminal [mAs] of the sense strand corresponds to the phosphorothioate linkage (e.g.,

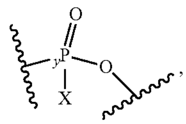, wherein X is —SH, i.e.,

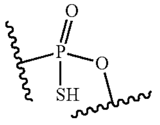)

of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formulae: (I), (I-a), (I-a-1), (I-b), (I-b-1), (I-c), (I-c-1), (I-d), (I-d-1), (I-e), (I-e-1), (I-f), (I-f-1), (I-g), (I-h), (I-i), (I-j), (II), (II-a), (II-b), (II-c), (III), (III-a), (IV), (IV-a), (IV-b), (IV-c), (IV-d), (IV-e), (IV-f), or ($Z^1$)-($Z^{16}$).

In some embodiments, an RNAi agent (e.g., a CYP7A1 RNAi agent described herein) comprises a sense strand and an antisense strand, wherein the nucleosides at positions 1, 2, 3, 4, 5, 6, 7, 8, 14, 15, 16, 17, 18, 20, and 21 (counting 5'→3') of the sense strand are nucleosides with a first 2' chemistry in the sugar moiety, e.g., 2'-F modified nucleosides, 2'-O-Me modified nucleosides, 2'-MOE modified nucleosides, or 2'-deoxy nucleosides, and the nucleosides at positions 9, 10, 11, 12, 13, and 19 (counting 5'→3') of the sense strand are nucleosides with a second 2' chemistry in the sugar moiety, e.g., 2'-F modified nucleosides, 2'-O-Me modified nucleosides, 2'-MOE modified nucleosides, or 2'-deoxy nucleosides, wherein the first 2' chemistry in the sugar moiety and the second 2' chemistry in the sugar moiety are different. In some embodiments, an RNAi agent (e.g., a CYP7A1 RNAi agent described herein) comprises a sense strand and an antisense strand, wherein the nucleosides at positions 1, 2, 3, 4, 5, 6, 7, 8, 14, 15, 16, 17, 18, 20, and 21 (counting 5'→3') of the sense strand are unmodified nucleosides, i.e., 2'-hydroxy nucleosides, and the nucleosides at positions 9, 10, 11, 12, 13, and 19 (counting 5'→3') of the sense strand are nucleosides with a different 2' chemistry in the sugar moiety, e.g., 2'-F modified nucleosides, 2'-O-Me modified nucleosides, 2'-MOE modified nucleosides, or 2'-deoxy nucleosides. In some embodiments, an RNAi agent (e.g., a CYP7A1 RNAi agent described herein) comprises a sense strand and an antisense strand, wherein the nucleosides at positions 9, 10, 11, 12, 13, and 19 (counting 5'→3') of the sense strand are unmodified nucleosides, i.e., 2'-hydroxy nucleosides, and the nucleosides at positions 1, 2, 3, 4, 5, 6, 7, 8, 14, 15, 16, 17, 18, 20, and 21 (counting 5'→3') of the sense strand are nucleosides with a different 2' chemistry in the sugar moiety, e.g., 2'-F modified nucleosides, 2'-O-Me modified nucleosides, 2'-MOE modified nucleosides, or 2'-deoxy nucleosides.

In some embodiments, an RNAi agent (e.g., a CYP7A1 RNAi agent described herein) comprises a sense strand and an antisense strand, wherein the nucleosides at positions 1, 2, 3, 4, 5, 6, 7, 8, 14, 15, 16, 17, 18, 20, and 21 (counting 5'→3') of the sense strand are 2'-O-Me modified nucleosides and the nucleosides at positions 9, 10, 11, 12, 13, and 19 (counting 5'→3') of the sense strand are unmodified nucleosides, i.e., 2'-hydroxy nucleosides.

In some embodiments, an RNAi agent (e.g., a CYP7A1 RNAi agent described herein) comprises a sense strand and an antisense strand, wherein the nucleosides at positions 1, 4, 11, 12, 16, 18, 21, 22, and 23 (counting 5'→3') of the antisense strand are nucleosides with a first 2' chemistry in the sugar moiety, e.g., 2'-F modified nucleosides, 2'-O-Me modified nucleosides, 2'-MOE modified nucleosides, or 2'-deoxy nucleosides, and the nucleosides at positions 2, 3, 5, 6, 7, 8, 9, 10, 13, 14, 15, 17, 19, and 20 (counting 5'→3') of the antisense strand are nucleosides with a second 2' chemistry in the sugar moiety, e.g., 2'-F modified nucleosides, 2'-O-Me modified nucleosides, 2'-MOE modified nucleosides, or 2'-deoxy nucleosides, wherein the first 2' chemistry in the sugar moiety and the second 2' chemistry in the sugar moiety are different. In some embodiments, an RNAi agent (e.g., a CYP7A1 RNAi agent described herein) comprises a sense strand and an antisense strand, wherein the nucleosides at positions 1, 4, 11, 12, 16, 18, 21, 22, and 23 (counting 5'→3') of the antisense strand are unmodified nucleosides, i.e., 2'-hydroxy nucleosides, and the nucleosides at positions 2, 3, 5, 6, 7, 8, 9, 10, 13, 14, 15, 17, 19, and 20 (counting 5'→3') of the antisense strand are nucleosides with a different 2' chemistry in the sugar moiety, e.g., 2'-F modified nucleosides, 2'-O-Me modified nucleosides, 2'-MOE modified nucleosides, or 2'-deoxy nucleoside. In some embodiments, an RNAi agent (e.g., a CYP7A1 RNAi agent described herein) comprises a sense strand and an antisense strand, wherein the nucleosides at positions 2, 3, 5, 6, 7, 8, 9, 10, 13, 14, 15, 17, 19, and 20 (counting 5'→3') of the antisense strand are unmodified nucleosides, i.e., 2'-hydroxy nucleosides, and the nucleosides at positions 1, 4, 11, 12, 16, 18, 21, 22, and 23 (counting 5'→3') of the antisense strand are nucleosides with a different 2' chemistry in the sugar moiety, e.g., 2'-F modified nucleosides, 2'-O-Me modified nucleosides, 2'-MOE modified nucleosides, or 2'-deoxy nucleosides.

In some embodiment, an RNAi agent (e.g., a CYP7A1 RNAi agent described herein) comprises a sense strand and an antisense strand, wherein the nucleosides at positions 1, 4, 11, 12, 16, 18, 21, 22, and 23 (counting 5'→3') of the antisense strand are the 2'-O-Me modified nucleosides, and the nucleosides at positions 2, 3, 5, 6, 7, 8, 9, 10, 13, 14, 15, 17, 19, and 20 (counting 5'→3') of the antisense strand are unmodified nucleosides, i.e., 2'-hydroxy nucleosides.

In some embodiments, a CYP7A1 RNAi agent described herein comprises an antisense strand that is 18-25 nucleosides (e.g., 18, 19, 20, 21, 22, 23, 24, or 25 nucleosides) in length and comprises at least 15 (e.g., 16, 17, 18, 19, 20, 21, 22, or 23) consecutive nucleobases of any one of SEQ ID NOs: 777-1160, and a sense strand that is 18-25 nucleosides (e.g., 18, 19, 20, 21, 22, 23, 24, or 25 nucleosides) in length and comprises at least 15 (e.g., 16, 17, 18, 19, 20, 21, 22, or 23) consecutive nucleobases of any one of SEQ ID NOs: 9-776, wherein the nucleosides at positions 1, 2, 3, 4, 5, 6, 7, 8, 14, 15, 16, 17, 18, 20, and 21 (counting 5'→3') of the sense strand are 2'-O-Me modified nucleosides and the nucleosides at positions 9, 10, 11, 12, 13, and 19 (counting 5'→3') of the sense strand are unmodified nucleosides, i.e., 2'-hydroxy nucleosides, and wherein the nucleosides at positions 1, 4, 11, 12, 16, 18, 21, 22, and 23 (counting 5'→3') of the antisense strand are the 2'-O-Me modified nucleosides, and the nucleosides at positions 2, 3, 5, 6, 7, 8, 9, 10, 13, 14, 15, 17, 19, and 20 (counting 5'→3') of the antisense strand are unmodified nucleosides, i.e., 2'-hydroxy nucleosides.

In some embodiments, a CYP7A1 RNAi agent described herein comprises an antisense strand comprising the nucleobase sequence of any one of SEQ ID NOs: 777-1160, and a sense strand comprising the nucleobase sequence of any one of SEQ ID NOs: 9-776, wherein the nucleosides at positions 1, 2, 3, 4, 5, 6, 7, 8, 13, 14, 15, 16, 17, 18, 19, 20, and 21 (counting 5'→3') of the sense strand are 2'-O-Me modified nucleosides and the nucleosides at positions 9, 10, 11, and 12 (counting 5'→3') of the sense strand are unmodified nucleosides, i.e., 2'-hydroxy nucleosides, and wherein the nucleosides at positions 1, 4, 11, 12, 18, 19, 20, 21, 22, and 23 (counting 5'→3') of the antisense strand are the 2'-O-Me modified nucleosides, and the nucleosides at positions 2, 3, 5, 6, 7, 8, 9, 10, 13, 14, 15, 16, and 17 (counting 5'→3') of the antisense strand are unmodified nucleosides, i.e., 2'-hydroxy nucleosides.

Additional Modified CYP7A1 RNAi Agents

In some embodiments, any one of the RNAi agents (e.g., CYP7A1 RNAi agents) described herein comprising nucleobase sequences (e.g., nucleobase sequences of the antisense strand and the sense strand) of the siRNAs listed in Table 5A and Table 7A can include any of the chemical modifications (e.g., one or more modified nucleosides and/or one or more modified internucleoside linkages) described below. In some embodiments, any one of the RNAi agents (e.g., CYP7A1 RNAi agents) described herein can include any of the chemical modifications as disclosed in Hu et al. Therapeutic siRNA: State of the Art. *Sig Transduct Target Ther* 5, 101 (2020), the entire contents of which is herein incorporated by reference.

In some embodiments, any one of the RNAi agents (e.g., CYP7A1 RNAi agents) described herein comprises any of the chemical modifications and/or modification patterns as disclosed in U.S. Pat. Nos. 10,233,448, 11,504,391, 9,290,760, 9,796,974, 9,399,775 9,796,974, 11,015,198, 10,676,742, 11,661,604, 11,655,473, and WO2022204430. The disclosures in these references related to chemical modifications of oligonucleotides (e.g., RNAi agents) are incorporated herein by reference.

In some embodiments, any one of the RNAi agents (e.g., CYP7A1 RNAi agents) described herein comprises one or more chemical modifications and/or modification patterns as described in U.S. Pat. Nos. 10,233,448, 11,504,391, 9,290,760, 9,796,974, 9,399,775, 9,796,974, and 11,015,198. For example, in some embodiments, any one of the RNAi agents (e.g., CYP7A1 RNAi agents) described herein comprises a sense strand and an antisense strand, wherein one or both of the sense strand and the antisense strand comprise chemical modifications on nucleosides of a portion or the entire strand that form an alternating motif. The term "alternating motif" refers to a type of modification pattern formed by one or more repeats of a sequence (e.g., a sequence of two, three, four, five, six, or more nucleosides), wherein each repeat of the sequence comprises a chemical modification on each nucleoside forming a pattern (e.g., an alternating pattern). For example, if A, B and C each represent one type of modified nucleoside, the alternating motif can be "ABABABABABAB . . . ," "AABBAABBAABB . . . ," "AABAABAABAAB . . . ," "AAABAAABAAAB . . . ," "AAABBBAAABBB . . . ," or "ABCABCABCABC . . . ," etc.

The type of modifications contained in an alternating motif may be the same or different. For example, if A, B, C, D each represent one type of modification on a nucleoside, an alternating motif, e.g., modifications on every other nucleoside, may be the same throughout the entire alternating motif (e.g., ABABABAB . . . throughout), or may be different in one portion of the motif than another portion (e.g., ABABABABACACACAC). In some embodiments, each of the sense strand or antisense strand can comprise several possibilities of alternating patterns such as "ABABAB . . . ," "ACACAC . . . ," "BDBDBD . . . ," or "CDCDCD . . . ," etc., within an alternating motif.

In some embodiments, any one of the RNAi agents (e.g., CYP7A1 RNAi agents) described herein may comprise, on one or both of the sense strand and the antisense strand, one or more alternating motifs. In some embodiments, the type of modifications contained in one or more alternating motif of the sense strand may be the same or different from the one or more alternating motifs of the antisense strand.

In some embodiments, an RNAi agent (e.g., a CYP7A1 RNAi agent) described herein comprises a sense strand and an antisense strand, wherein the sense strand comprises a different alternating motif relative to the alternating motif on the antisense strand.

In some embodiments, any one of the RNAi agents (e.g., CYP7A1 RNAi agents) described herein comprises a sense strand and an antisense strand, each of which comprises an alternating motif composed of the same types of modifications on nucleosides, but each nucleoside on the antisense strand comprises a different modification than the nucleoside it base pairs with on the sense strand. In some embodiments, in an RNAi agent (e.g., a CYP7A1 RNAi agent) described herein, the sense strand when paired with the antisense strand to form a duplex region, the alternating motif in the sense strand may start with "ABABAB" from 5'→3' of the sense strand and the alternating motif in the antisense strand may start with "ABABAB" from 5'→3' of the antisense strand within the duplex region. In some embodiments, the alternating motif in the sense strand may start with "AABBAABB" from 5' →3' of the sense strand and the alternating motif in the antisense strand may start with "AABBAABB" from 5'→3' of the antisense strand within the duplex region. In some embodiments, in an RNAi agent (e.g., a CYP7A1 RNAi agent) described herein, the sense strand when paired with the antisense strand to form a duplex region, the alternating motif in the sense strand may start with "ABA-BAB" from 5'→3' of the sense strand and the alternating motif in the antisense strand may start with "BABABA" from 5'→3' of the antisense strand within the duplex region. In some embodiments, the alternating motif in the sense strand may start with "AABBAABB" from 5'→3' of the sense strand and the alternating motif in the antisense strand may start with "BBAABBAA" from 5'→3' of the antisense strand within the duplex region.

In some embodiments, any one of the RNAi agents (e.g., CYP7A1 RNAi agents) described herein comprises a sense strand and an antisense strand, wherein the sense strand or the antisense strand comprises at least two different types of modified nucleosides (e.g., 2'-O-Me and 2'-F modified nucleosides). In some embodiments, any one of the RNAi agents (e.g., CYP7A1 RNAi agents) described herein comprises a sense strand and an antisense strand, wherein each of the sense strand and the antisense strand comprises at least two different types of modified nucleosides (e.g., 2'-O-Me and 2'-F modified nucleosides) on each strand. In some embodiments, any one of the RNAi agents (e.g., CYP7A1 RNAi agents) described herein comprises a sense strand and an antisense strand, wherein each nucleoside of the sense strand and the antisense strand is a modified nucleoside, and wherein each of the sense strand and the antisense strand comprises an alternating motif of 2'-F modified nucleosides and 2'-O-Me modified nucleosides.

In some embodiments, any one of the RNAi agents (e.g., CYP7A1 RNAi agents) described herein comprises a sense strand and an antisense strand, wherein the sense strand comprises an alternating motif of 2'-O-Me modified nucleosides and 2'-F modified nucleosides and the antisense strand comprises an alternating motif of 2'-O-Me modified nucleosides and 2'-F modified nucleosides, wherein a 2'-O-Me modified nucleoside on the sense strand base pairs with a 2'-F modified nucleoside on the antisense strand and vice versa. In some embodiments, position 1 (counting 5'→3') of the sense strand is a 2'-F modified nucleoside, and the corresponding position of the antisense strand is a 2'-O-Me modified nucleoside. In some embodiments, position 1 (counting 5'→3') of the sense strand is a 2'-O-Me modified nucleoside, and the corresponding position of the antisense strand is a 2'-F modified nucleoside. In some embodiments, an RNAi agent (e.g., CYP7A1 RNA agent) further comprises one or more phosphorothioate internucleoside linkages. In some embodiments, the first two internucleoside linkages (from 5'→3') and the last two internucleoside linkages (from 5'→3') of the sense strand are internucleoside linkages and/or (e.g., and) the last two internucleoside linkages (from 5'→3') of the antisense strand are internucleoside linkages. In some embodiments, the sense strand and the antisense strand are both 19 nucleosides in length and for a duplex of 19 base pairs in length.

In some embodiments, any one of the RNAi agents (e.g., CYP7A1 RNAi agents) described herein comprises a sense strand and an antisense strand, wherein one or both of the sense strand and the antisense strand comprises one or more motifs of three consecutive nucleosides with identical sugar modifications (e.g., identical 2'-modifications). In some embodiments, at least one of the one or more motifs of three nucleosides is located on the sense and/or antisense strand at positions corresponding to or near the site on a target mRNA where cleavage occurs (these positions on the sense and/or antisense strand are collectively referred to herein as the "cleavage site"). In some embodiments, at least one of the one or more motifs of three nucleosides is located at or near the cleavage site on the antisense strand (e.g., positions 10, 11, and 12 (counting 5'→3') of the antisense strand). For an RNAi agent (e.g., a CYP7A1 RNAi agent) described herein comprising a duplex region of 19-23 nucleosides in length, the positions on the antisense strand corresponding to the cleavage site is typically around positions 10, 11, and 12 (counting 5'→3'). Thus, the three identical sugar modifications (e.g., identical 2'-modifications) may occur at positions 9, 10, 11; positions 10, 11, 12; positions 11, 12, 13; positions 12, 13, 14; or positions 13, 14, 15 of the antisense strand (counting 5'→3' or counting from the first paired nucleoside within the duplex region from the 5'-end of the antisense strand). The positions on the antisense strand corresponding to the cleavage site may also change according to the length of the duplex region of the RNAi agent from the 5'-end.

In some embodiments, when the sense strand and antisense strand of an RNAi agent comprise one or more motifs of three consecutive nucleosides with identical sugar modifications (e.g., identical 2'-modifications) at or near the cleavage site on at least one strand of an RNAi agent, gene silencing activity of the RNAi agent is observed.

In some embodiments, the sense strand of an RNAi agent (e.g., a CYP7A1 RNAi agent) described herein comprises at least one motif of three consecutive nucleosides with identical sugar modifications (e.g., identical 2'-modifications), wherein at least one of the motifs occurs at or near the cleavage site on the sense strand.

In some embodiments, the antisense strand of the RNAi agent comprises at least one motif of three consecutive nucleosides with identical sugar modifications (e.g., identical 2'-modifications), wherein at least one of the motifs occurs at or near the cleavage site on the antisense strand.

In some embodiments, the rest of the nucleosides in the sense strand and antisense strand of the RNAi agent are modified nucleosides. In some embodiments, the rest of the nucleosides in the sense strand and antisense strand of the RNAi agent are modified nucleosides with a different modification than the modification on the motif of three consecutive nucleosides with identical sugar modifications (e.g., identical 2'-modifications).

In some embodiments, the sense strand of an RNAi agent (e.g., a CYP7A1 RNAi agent) described herein comprises at least one motif of three consecutive nucleosides with identical sugar modifications (e.g., identical 2'-modifications) at or near the cleavage site on the sense strand and the antisense strand comprises at least one motif of three consecutive nucleosides with identical sugar modifications (e.g., identical 2'-modifications) at or near the cleavage site on the antisense strand. When the sense strand and the antisense strand form a duplex region, the sense strand and the antisense strand can be so aligned that one motif of the three consecutive nucleosides with identical sugar modifications (e.g., identical 2'-modifications) on the sense strand and one motif of the three consecutive nucleosides with identical sugar modifications (e.g., identical 2'-modifications) on the antisense strand have at least one nucleoside overlap, i.e., at least one of the three consecutive nucleosides of the motif on the sense strand forms a base pair with at least one of the three consecutive nucleosides of the motif on the antisense strand. Alternatively, at least two nucleosides may overlap, or all three nucleosides may overlap. In some embodiments, the overlapping nucleoside on the sense strand comprises a different sugar modification than the nucleoside it overlaps with on the antisense strand.

In some embodiments, an RNAi agent (e.g., a CYP7A1 RNAi agent) described herein is an RNAi agent comprising a duplex region of 19 nucleosides in length, wherein the duplex region is formed by a sense strand and an antisense strand, wherein the nucleosides at three consecutive positions of the sense strand are 2'-F modified nucleosides and the nucleosides at three consecutive positions of the antisense strand are 2'-O-Me modified nucleosides. In some embodiments, the nucleosides at positions 7, 8, and 9 (counting 5'→3') of the sense strand are 2'-F modified nucleosides and the nucleosides at positions 11, 12, and 13 (counting 5'→3') of the antisense strand are 2'-O-Me modified nucleosides.

In some embodiments, an RNAi agent (e.g., a CYP7A1 RNAi agent described herein) is an RNAi agent comprising a duplex region of 20 nucleosides in length, wherein the duplex region is formed by a sense strand and an antisense strand, wherein the nucleosides at three consecutive positions of the sense strand are 2'-F modified nucleosides and the nucleosides at three consecutive positions of the antisense strand are 2'-O-Me modified nucleosides. In some embodiments, the nucleosides at positions 8, 9, and 10 (counting 5'→3') of the sense strand are 2'-F modified nucleosides and the nucleosides at positions 11, 12, and 13 (counting 5'→3') of the antisense strand are 2'-O-Me modified nucleosides.

In some embodiments, an RNAi agent (e.g., a CYP7A1 RNAi agent) described herein is an RNAi agent comprising a duplex region of 21 nucleosides in length, wherein the duplex region is formed by a sense strand and an antisense strand, wherein nucleosides at three consecutive positions of the sense strand are 2'-F modified nucleosides and the nucleosides at three consecutive positions of the antisense strand are 2'-O-Me modified nucleosides. In some embodiments, the nucleosides at positions 9, 10, and 11 (counting 5'→3') of the sense strand are 2'-F modified nucleosides and the nucleosides at positions 11, 12, and 13 (counting 5'→3') of the antisense strand are 2'-O-Me modified nucleosides.

In some embodiments, an RNAi agent (e.g., a CYP7A1 RNAi agent) described herein comprises a sense strand and an antisense strand wherein the sense strand is 21 nucleosides in length and the antisense strand is 23 nucleosides in length, wherein the sense strand comprises at least one motif of three consecutive nucleosides with identical sugar modifications (e.g., 2'-F modified nucleosides) and the antisense strand comprises at least one motif of three consecutive nucleosides with identical sugar modifications (e.g., 2'-O-Me modified nucleosides). In some embodiments, the nucleosides at positions 9, 10, and 11 (counting 5'→3') of the sense strand are 2'-F modified nucleosides and the nucleosides at positions 11, 12, and 13 (counting 5'→3') of the antisense strand are 2'-O-Me modified nucleosides. In some embodiments, the rest of the nucleosides in the sense strand and the antisense strand of the RNAi agent are modified nucleosides (e.g., 2' modified nucleosides). In some embodiments, the rest of the nucleosides in the sense strand and antisense strand are a mix of 2'-F modified nucleosides and 2'-O-Me modified nucleosides.

In some embodiments, any one of the RNAi agents (e.g., CYP7A1 RNAi agents) described herein comprises a sense strand and an antisense strand, wherein one or both of the sense strand and the antisense strand comprise the at least one motif of three consecutive nucleosides with identical sugar modifications (e.g., identical 2'-modifications) at or near the cleavage site and comprise one or more alternating motifs. In some embodiments, the nucleosides at positions 9, 10, and 11 (counting 5'→3') of the sense strand are 2'-F modified nucleosides and the nucleosides at positions 11, 12, and 13 (counting 5'→3') of the antisense strand are 2'-O-Me modified nucleosides, and the rest of the nucleosides in the sense strand and the antisense strand comprise alternating motifs of 2'-O-Me modified nucleosides and 2'-F modified nucleosides.

In some embodiments, when the motif of three consecutive nucleosides with identical sugar modifications (e.g., identical 2'-modifications) is present on any of the strands, the modification of the nucleoside next to the motif is a different modification than the modification of the motif. For example, in some embodiments, the portion of the sequence containing the motif is " . . . $N_a$YYY$N_b$ . . . ," wherein "Y" represents the modification of the motif of three consecutive nucleosides with identical sugar modifications (e.g., identical 2'-modifications), and "$N_a$" and "$N_b$" represent a modification to the nucleoside next to the motif "YYY" that is different than the modification of Y, and where $N_a$ and $N_b$ can be the same or different modifications.

In some embodiments, an RNAi agent comprising a sense strand and an antisense strand each or both comprising one or more motifs of three consecutive nucleosides with identical sugar modifications (e.g., identical 2'-modifications) and alternating motifs described herein comprise two blunt ends, one blunt end and one end with an overhang, or two ends each with overhangs. In some embodiments, one end of the RNAi agent is blunt, while the other end comprises a two nucleoside overhang (e.g., formed by a sense strand of 21 nucleosides in length and an antisense strand of 23 nucleosides in length). In some embodiments, the two nucleoside overhang is at the 3'-end of the antisense strand.

In some embodiments, a two nucleoside overhang is at the 3'-end of the antisense strand, and the antisense strand comprises two phosphorothioate internucleoside linkages between the terminal three nucleosides, wherein two of the three nucleosides are the overhang nucleosides, and the third nucleoside is a paired nucleoside next to the overhang nucleoside. In some embodiments, the RNAi agent further comprises two phosphorothioate internucleoside linkages of the sense strand (e.g., first two internucleoside linkages from 5'→3') and two phosphorothioate internucleoside linkages in the antisense strand (e.g., first two internucleoside linkages from 5'→3').

In some embodiments, any one of the RNAi agents (e.g., CYP7A1 RNAi agents) described herein comprises a sense strand and an antisense strand, wherein the sense strand is 21 nucleosides in length, wherein the nucleosides at positions 1, 3, 5, 7, 9, 10, 11, 13, 15, 17, 19, and 21 (counting 5'→3') of the sense strand are 2'-F modified nucleosides and wherein the nucleosides at positions 2, 4, 6, 8, 12, 14, 16, 18, and 20 (counting 5'→3') of the sense strand are 2'-O-Me modified nucleosides, wherein the antisense strand is 23 nucleosides in length, wherein the nucleosides at positions 2, 4, 6, 8, 10, 14, 16, 18, 20, and 22 (counting 5'→3') of the antisense strand are 2'-F modified nucleosides, wherein the nucleosides at positions 1, 3, 5, 7, 9, 11, 12, 13, 15, 17, 19, 21, and 23 (counting 5'→3') of the antisense strand are 2'-O-Me modified nucleosides, and wherein the last two internucleoside linkages of the antisense strand (counting 5'→3') are phosphorothioate internucleoside linkages, and wherein the RNAi agent has a two nucleoside overhang at the 3'-end of the antisense strand, and a blunt end at the 5'-end of the antisense strand.

In some embodiments, an RNAi agent (e.g., a CYP7A1 RNAi agent) described herein comprises a sense strand and an antisense strand, wherein one or both of the sense strand and the antisense strand comprise more than one (e.g., 2, 3, or more) motifs of three consecutive nucleosides with identical sugar modifications (e.g., identical 2'-modifications). The first motif may occur at or near the cleavage site on the sense strand or antisense strand and the other motif(s) may occur at another portion of the strand that is separated from (e.g., by at least one or more nucleosides) the first motif or may be adjacent to the first motif. When the other motif(s) are adjacent to the first motif, the chemistries are different from that of the first motif. When the motifs are separated by one or more nucleosides, the chemistries can be the same or different. In some embodiments, when two other motifs are present, each motif may occur at one end relative to the first motif which is at or near cleavage site or on either side of the first motif.

Like the sense strand, in some embodiments, the antisense strand of the RNAi agent may contain more than one motif (e.g., 2, 3, or more) of three consecutive nucleosides with identical sugar modifications (e.g., identical 2'-modifications), with at least one of the motifs occurring at or near the cleavage site on the strand. In some embodiments, the antisense strand comprises one or more motifs of three consecutive nucleosides with identical sugar modifications (e.g., identical 2'-modifications) in an alignment with the motifs of three consecutive nucleosides with identical sugar modifications (e.g., identical 2'-modifications) that are present on the sense strand.

In some embodiments, a motif of three consecutive nucleosides with identical sugar modifications (e.g., identical 2'-modifications) on the sense strand or antisense strand of the RNAi agent typically does not include the first one or two nucleosides at the 3'-end, 5'-end, or both ends of the strand.

In some embodiments, a motif of three consecutive nucleosides with identical sugar modifications (e.g., identical 2'-modifications) on the sense strand or antisense strand of the RNAi agent typically does not include the first one or two paired nucleosides within the duplex region at the 3'-end, 5'-end, or both ends of the strand.

When the sense strand and the antisense strand of the RNAi agent each comprise at least one motif of three consecutive nucleosides with identical sugar modifications (e.g., identical 2'-modifications), the motifs may fall on the same end of the duplex region, and have an overlap of one, two, or three nucleosides.

When the sense strand and the antisense strand of the RNAi agent each comprise at least two motifs of three consecutive nucleosides with identical sugar modifications (e.g., identical 2'-modifications), the sense strand and the antisense strand can be so aligned that two modifications each from one strand fall on one end of the duplex region, comprising an overlap of one, two, or three nucleosides; two modifications each from one strand fall on the other end of the duplex region, comprising an overlap of one, two or three nucleosides; two modifications one strand fall on each side of the lead motif, comprising an overlap of one, two or three nucleosides in the duplex region.

In some embodiments, any one of the RNAi agents (e.g., CYP7A1 RNAi agents) described herein comprises a motif of three consecutive nucleosides with identical sugar modifications (e.g., identical 2'-modifications) at the 5' end or 3' end of the sense strand and/or the antisense strand. In some embodiments, the antisense strand comprises a motif of three consecutive nucleosides with identical sugar modifications (e.g., identical 2'-modifications) at the 3' end of the strand. In some embodiments, any one of the RNAi agents (e.g., CYP7A1 RNAi agents) described herein comprises a sense strand and an antisense strand, wherein the sense strand and antisense strand each comprise a motif of three consecutive nucleosides with identical sugar modifications (e.g., identical 2'-modifications) at or near the cleavage site, wherein the RNAi agents further comprise a motif of three consecutive nucleosides with identical sugar modifications (e.g., identical 2'-modifications) at the 3' end of the sense strand, and wherein the sense strand and antisense strand each comprise an alternating motif comprising chemical modifications in an alternating pattern. In some embodiments, the nucleosides at positions 9, 10, and 11 (counting 5'→3') of the sense strand are 2'-F modified nucleosides and the nucleosides at positions 11, 12, and 13 (counting 5'→3') of the antisense strand are 2'-O-Me modified nucleosides and the rest of the nucleosides in the sense strand and the antisense strand comprise one or more alternating motifs.

In some embodiments, any one of the RNAi agents (e.g., CYP7A1 RNAi agents) described herein comprises a sense strand and an antisense strand, wherein the sense strand is 21 nucleosides in length, wherein the nucleosides at positions 1, 3, 5, 7, 9, 10, 11, 13, 15, 17, 19, and 21 (counting 5'→3') of the sense strand are 2'-F modified nucleosides and wherein the nucleosides at positions 2, 4, 6, 8, 12, 14, 16, 18, and 20 (counting 5'→3') of the sense strand are 2'-O-Me modified nucleosides, wherein the antisense strand is 23 nucleosides in length, wherein the nucleosides at positions 2, 4, 6, 8, 10, 14, 16, 18, and 20 (counting 5' 3') of the antisense strand are 2'-F modified nucleosides, wherein the nucleosides at positions 1, 3, 5, 7, 9, 11, 12, 13, 15, 17, 19, 21, 22, and 23 (counting 5'→3') of the antisense strand are 2'-O-Me modified nucleosides, wherein the first two internucleoside linkages of the sense strand (counting 5'→3') are phosphorothioate internucleoside linkages, wherein the first two and last two internucleoside linkages of the antisense strand (counting 5'→3') are phosphorothioate internucleoside linkages, and wherein the RNAi agent has a two nucleoside overhang at the 3'-end of the antisense strand, and a blunt end at the 5'-end of the antisense strand.

In some embodiments, the sense strand comprises modified nucleosides that form a modification pattern represented by formula (IV):

(IV)

$$5'\ n_p\text{-}N_a\text{-}(X\ X\ X)_i\text{-}N_b\text{-}Y\ Y\ Y\text{-}N_b\text{-}(Z\ Z\ Z)_j\text{-}N_a\text{-}n_q\ 3'$$

wherein:

i and j are each independently 0 or 1;

p and q are each independently 0-6;

each $N_a$ independently represents an oligonucleotide sequence comprising 0-25 modified nucleosides, each sequence comprising at least two differently modified nucleosides;

each $N_b$ independently represents an oligonucleotide sequence comprising 0-10 modified nucleosides;

each $n_p$ and $n_q$ independently represent an overhang nucleoside;

wherein $N_b$ and Y do not have the same modification; and

XXX, YYY, and ZZZ each independently represent one motif of three consecutive nucleosides with identical sugar modifications (e.g., identical 2'-modifications). Preferably YYY is all 2'-F modified nucleosides.

In some embodiments, the $N_a$ or $N_b$ comprises an alternating pattern of modified nucleosides.

In some embodiments, the YYY motif occurs at or near the cleavage site on the sense strand. For example, when the RNAi agent has a duplex region of 17-23 nucleosides in length, the YYY motif can occur at or the near the cleavage site (e.g.: can occur at positions 6, 7, 8; 7, 8, 9; 8, 9, 10; 9, 10, 11; 10, 11, 12; or 11, 12, 13) on the sense strand, (counting 5'→3') or counting from the first paired nucleoside within the duplex region, from the 5'-end.

In one embodiment, i is 1 and j is 0, or i is 0 and j is 1, or both i and j are 1. The sense strand can therefore be represented by the following formulas:

(IVb)
5' $n_p$-$N_a$-YYY-$N_b$-ZZZ-$N_a$-$n_q$ 3';

(IVc)
5' $n_p$-$N_a$-XXX-$N_b$-YYY-$N_a$-$n_q$ 3';
or (IVd)
5' $n_p$-$N_a$-XXX-$N_b$-YYY-$N_b$-ZZZ-$N_a$-$n_q$ 3'.

When the sense strand is represented by formula (IVb), $N_b$ represents an oligonucleotide sequence comprising 0-10, 0-7, 0-5, 0-4, 0-2, or 0 modified nucleosides. Each $N_a$ independently can represent an oligonucleotide sequence comprising 2-20, 2-15, or 2-10 modified nucleosides.

When the sense strand is represented as formula (IVc), $N_b$ represents an oligonucleotide sequence comprising 0-10, 0-7, 0-10, 0-7, 0-5, 0-4, 0-2, or 0 modified nucleosides. Each $N_a$ can independently represent an oligonucleotide sequence comprising 2-20, 2-15, or 2-10 modified nucleosides.

When the sense strand is represented as formula (IVd), each $N_b$ independently represents an oligonucleotide sequence comprising 0-10, 0-7, 0-5, 0-4, 0-2, or 0 modified nucleosides. Preferably, $N_b$ is 0, 1, 2, 3, 4, 5, or 6. Each $N_a$ can independently represent an oligonucleotide sequence comprising 2-20, 2-15, or 2-10 modified nucleosides.

Each of X, Y and Z may be the same or different from each other.

In some embodiments, i is 0 and j is 0, and the sense strand may be represented by the formula:

(IVa)
5' $n_p$-$N_a$-YYY-$N_a$-$n_q$ 3'.

When the sense strand is represented by formula (IVa), each $N_a$ independently can represent an oligonucleotide sequence comprising 2-20, 2-15, or 2-10 modified nucleosides.

In one embodiment, the antisense strand sequence of the RNAi may be represented by formula (V):

(V)
5' $n_{q'}$-$N_a$'-(Z'Z'Z')$_k$-$N_b$'-Y'Y'Y'-$N_b$'-(X'X'X')$_l$-N'$_a$-$n_p$' 3' wherein:

k and l are each independently 0 or 1;

p' and q' are each independently 0-6;

each $N_a$' independently represents an oligonucleotide sequence comprising 0-25 modified nucleosides, each sequence comprising at least two differently modified nucleosides;

each $N_b$' independently represents an oligonucleotide sequence comprising 0-10 modified nucleosides;

each $n_p$' and $n_q$' independently represent an overhang nucleoside; wherein $N_b$' and Y' do not have the same modification; and X'X'X', Y'Y'Y', and Z'Z'Z' each independently represent one motif of three consecutive nucleosides with identical sugar modifications (e.g., identical 2'-modifications).

In some embodiments, the $N_a$' or $N_b$' comprises an alternating pattern of modified nucleosides.

The Y'Y'Y' motif occurs at or near the cleavage site on the antisense strand. For example, when the RNAi agent has a duplex region of 17-23 nucleosides in length, the Y'Y'Y' motif can occur at positions 9, 10, 11; 10, 11, 12; 11, 12, 13; 12, 13, 14; or 13, 14, 15 of the antisense strand, with the count starting from the first nucleoside, from the 5'-end; or optionally, the count starting at the first paired nucleoside within the duplex region, from the 5'-end. Preferably, the Y'Y'Y' motif occurs at positions 11, 12, 13.

In some embodiments, Y'Y'Y' motif is all 2'-O-Me modified nucleosides.

In some embodiments, k is 1 and l is 0, or k is 0 and l is 1, or both k and l are 1.

The antisense strand can therefore be represented by the following formulas:

(Vb)
5' $n_{q'}$-$N_a$'-Z'Z'Z'-$N_b$'-Y'Y'Y'-$N_a$'-np' 3';

(IIc)
5' $n_{q'}$-$N_a$'-Y'Y'Y'-$N_b$'-X'X'X'-$n_{p'}$ 3';
or (Vd)
5' $n_{q'}$-$N_a$'-Z'Z'Z'-$N_b$'-Y'Y'Y'-$N_b$'-X'X'X'-$N_a$'-$n_{p'}$ 3'.

When the antisense strand is represented by formula (IIb), $N_b$' represents an oligonucleotide sequence comprising 0-10, 0-7, 0-10, 0-7, 0-5, 0-4, 0-2, or 0 modified nucleosides. Each $N_a$' independently represents an oligonucleotide sequence comprising 2-20, 2-15, or 2-10 modified nucleosides.

When the antisense strand is represented as formula (Vc), $N_b$' represents an oligonucleotide sequence comprising 0-10, 0-7, 0-10, 0-7, 0-5, 0-4, 0-2, or 0 modified nucleosides. Each $N_a$' independently represents an oligonucleotide sequence comprising 2-20, 2-15, or 2-10 modified nucleosides.

When the antisense strand is represented as formula (Vd), each $N_b$' independently represents an oligonucleotide sequence comprising 0-10, 0-7, 0-10, 0-7, 0-5, 0-4, 0-2, or 0 modified nucleosides. Each $N_a$' independently represents an oligonucleotide sequence comprising 2-20, 2-15, or 2-10 modified nucleosides. Preferably, $N_b$ is 0, 1, 2, 3, 4, 5, or 6.

In some embodiments, k is 0 and l is 0 and the antisense strand may be represented by the formula:

(IVa)
5' $n_{p'}$-$N_{a'}$-Y'Y'Y'-$N_{a'}$-$n_{q'}$ 3'.

When the antisense strand is represented as formula (Va), each $N_a$' independently represents an oligonucleotide sequence comprising 2-20, 2-15, or 2-10 modified nucleosides. Each of X', Y' and Z' may be the same or different from each other.

Each nucleoside of the sense strand and antisense strand may be independently modified with LNA, CRN, UNA, GNA, cEt, HNA, CeNA, 2'-methoxyethyl, 2'-O-Me, 2'-O-allyl, 2'-C-allyl, 2'-hydroxyl, or 2'-F. For example, each nucleoside of the sense strand and antisense strand is independently modified with 2'-O-Me or 2'-F. Each X, Y, Z, X', Y', and Z', in particular, may represent a 2'-O-Me modified nucleoside or a 2'-F modified nucleoside.

In some embodiments, the sense strand of the RNAi agent may contain YYY motif occurring at 9, 10, and 11 positions of the strand when the duplex region is 21 nucleosides, the count starting from the first nucleoside from the 5'-end, or optionally, the count starting at the first paired nucleoside within the duplex region, from the 5'-end; and Y represents a 2'-F modified nucleoside. The sense strand may additionally contain XXX motif or ZZZ motifs at the opposite end of the duplex region; and XXX and ZZZ each independently represents a 2'-O-Me modified nucleoside or a 2'-F modified nucleoside.

In some embodiments the antisense strand may contain Y'Y'Y' motif occurring at positions 11, 12, 13 of the strand, the count starting from the first nucleoside from the 5'-end, or optionally, the count starting at the first paired nucleoside within the duplex region, from the 5'-end; and Y' represents 2'-O-Me modification. The antisense strand may additionally contain X'X'X' motif or Z'Z'Z' motifs at the opposite end of the duplex region; and X'X'X' and Z'Z'Z' each independently represents a 2'-O-Me modified nucleoside or a 2'-F modified nucleoside.

The sense strand represented by any one of the above formulas (IVa), (IVb), (IVc), and (IVd) forms a duplex with an antisense strand being represented by any one of formulas (Va), (Vb), (Vc), and (Vd), respectively.

Accordingly, any one of the RNAi agents (e.g., CYP7A1 RNAi agents) described herein may comprise a sense strand and an antisense strand, each strand comprising 14 to 30 nucleosides, the RNAi agent represented by formula (VI):

(VI)

sense:

$5'\ n_p\text{-}N_a\text{-}(X\ X\ X)_i\text{-}N_b\text{-}Y\ Y\ Y\text{-}N_b\text{-}(ZZZ)_j\text{-}N_a\text{-}n_q\ 3'$ antisense:

$3'\ n_p'\text{-}N_a'\text{-}(X'X'X')_k\text{-}N_b'\text{-}Y'Y'Y'\text{-}N_b'\text{-}(Z'Z'Z')_l\text{-}N_a'\text{-}n_q'\ 5'$ wherein:

i, j, k, and l are each independently 0 or 1;

p, p', q, and q' are each independently 0-6;

each $N_a$ and $N_a'$ independently represents an oligonucleotide sequence comprising 0-25 modified nucleosides, each sequence comprising at least two differently modified nucleosides;

each $N_b$ and $N_b'$ independently represents an oligonucleotide sequence comprising 0-10 modified nucleosides;

wherein each $n_p'$, $n_p$, $n_q'$, and $n_q$, each of which may or may not be present, independently represents an overhang nucleoside; and XXX, YYY, ZZZ, X'X'X', Y'Y'Y', and Z'Z'Z' each independently represent one motif of three consecutive nucleosides with identical sugar modifications (e.g., identical 2'-modifications).

In one embodiment, i is 0 and j is 0; or i is 1 and j is 0; or i is 0 and j is 1; or both i and j are 0; or both i and j are 1. In another embodiment, k is 0 and l is 0; or k is 1 and l is 0; k is 0 and l is 1; or both k and l are 0; or both k and l are 1.

Exemplary combinations of the sense strand and antisense strand forming a RNAi agent include the formulas below:

(VIa)

$5'\ n_p\text{-}N_a\text{-}Y\ Y\ Y\text{-}N_a\text{-}n_q\ 3'$ $3'\ n_p'\text{-}N_a'\text{-}Y'Y'Y'\text{-}N_a'\ n_q'\ 5'$ (VIb)

$5'\ n_p\text{-}N_a\text{-}Y\ Y\ Y\text{-}N_b\text{-}Z\ Z\ Z\text{-}N_a\text{-}n_q\ 3'$ $3'\ n_p'\text{-}N_a'\text{-}Y'Y'Y'\text{-}N_b'\text{-}Z'Z'Z'\text{-}N_a'\ n_q\ 5'$ (VIc)

$5'\ n_p\text{-}N_a\text{-}X\ X\ X\text{-}N_b\text{-}Y\ Y\ Y\text{-}N_a\text{-}n_q\ 3'$ $3'\ n_p'\text{-}N_a'\text{-}X'X'X'\text{-}N_b'\text{-}Y'Y'Y'\text{-}N_a'\text{-}n_q'\ 5'$ (VId)

$5'\ n_p\text{-}N_a\text{-}X\ X\ X\ \text{-}N_b\text{-}Y\ Y\ Y\text{-}N_b\text{-}Z\ Z\ Z\text{-}N_a\text{-}n_q\ 3'$ $3'\ n_p'\text{-}N_a'\text{-}X'X'X'\text{-}N_b'\text{-}Y'Y'Y'\text{-}N_b'\text{-}Z'Z'Z'\text{-}N_a'\text{-}n_q'\ 5'$ When the RNAi agent is represented by formula (VIa), each $N_a$ independently represents an oligonucleotide sequence comprising 2-20, 2-15, or 2-10 modified nucleosides.

When the RNAi agent is represented by formula (VIb), each $N_b$ independently represents an oligonucleotide sequence comprising 1-10, 1-7, 1-5, or 1-4 modified nucleosides. Each $N_a$ independently represents an oligonucleotide sequence comprising 2-20, 2-15, or 2-10 modified nucleosides.

When the RNAi agent is represented as formula (VIc), each $N_b$, $N_b'$ independently represents an oligonucleotide sequence comprising 0-10, 0-7, 0-10, 0-7, 0-5, 0-4, 0-2, or 0 modified nucleosides. Each $N_a$ independently represents an oligonucleotide sequence comprising 2-20, 2-15, or 2-10 modified nucleosides.

When the RNAi agent is represented as formula (VId), each $N_b$, $N_b'$ independently represents an oligonucleotide sequence comprising 0-10, 0-7, 0-10, 0-7, 0-5, 0-4, 0-2, or 0 modified nucleosides. Each $N_a$, $N_a'$ independently represents an oligonucleotide sequence comprising 2-20, 2-15, or 2-10 modified nucleosides. Each of $N_a$, $N_a'$, $N_b$, and $N_b'$ independently comprises an alternating pattern of modified nucleosides.

Each of X, Y, and Z in formulas (VI), (VIa), (VIb), (VIc), and (VId) may be the same or different from each other.

When the RNAi agent is represented by formula (VI), (VIa), (VIb), (VIc), and (VId), at least one of the Y nucleosides may form a base pair with one of the Y' nucleosides. Alternatively, at least two of the Y nucleosides form base pairs with the corresponding Y' nucleosides; or all three of the Y nucleosides all form base pairs with the corresponding Y' nucleosides.

When the RNAi agent is represented by formula (VIb) or (VId), at least one of the Z nucleosides may form a base pair with one of the Z' nucleosides. Alternatively, at least two of the Z nucleosides form base pairs with the corresponding Z' nucleosides; or all three of the Z nucleosides all form base pairs with the corresponding Z' nucleosides.

When the RNAi agent is represented as formula (VIc) or (VId), at least one of the X nucleosides may form a base pair with one of the X' nucleosides. Alternatively, at least two of the X nucleosides form base pairs with the corresponding X' nucleosides; or all three of the X nucleosides all form base pairs with the corresponding X' nucleosides.

In some embodiments, the modification on the Y nucleoside is different than the modification on the Y' nucleoside, the modification on the Z nucleoside is different than the modification on the Z' nucleoside, or the modification on the X nucleoside is different than the modification on the X' nucleoside.

In some embodiments, when the RNAi agent is represented by formula (VId), $N_a$ modified nucleosides are 2'-O-Me modified nucleosides or 2'-F modified nucleosides. In some embodiments, when the RNAi agent is represented by formula (VId), the $N_a$ modified nucleosides are 2'-O-Me or 2'-F modified nucleosides and $n_p$'>0 and at least one $n_p$' is linked to a neighboring nucleoside via a phosphorothioate linkage. In some embodiments, when the RNAi agent is represented by formula (VId), the $N_a$ modified nucleosides are 2'-O-Me or 2'-F modified nucleosides, $n_p$'>0 and at least one $n_p$' is linked to a neighboring nucleoside via phosphorothioate linkage. In some embodiments, when the RNAi agent is represented by formula (VId), the $N_a$ modified nucleosides are 2'-O-Me or 2'-F modifications, $n_p$'>0 and at least one $n_p$' is linked to a neighboring nucleoside via phosphorothioate linkage, and the sense strand comprises at least one phosphorothioate linkage.

In some embodiments, when the RNAi agent is represented by formula (VIa), the $N_a$ modified nucleosides are 2'-O-Me or 2'-F modifications, $n_p$'>0 and at least one $n_p$' is linked to a neighboring nucleoside via phosphorothioate linkage, and the sense strand comprises at least one phosphorothioate linkage.

In some embodiments, the RNAi agent is a multimer containing at least two duplexes represented by formula (VI), (VIa), (VIb), (VIc), and (VId), wherein the duplexes are connected by a linker. The linker can be cleavable or non-cleavable. Each of the duplexes can target the same gene or two different genes; or each of the duplexes can target same gene at two different target sites.

In some embodiments, the RNAi agent is a multimer containing three, four, five, six, or more duplexes represented by formula (VI), (VIa), (VIb), (VIc), and (VId), wherein the duplexes are connected by a linker. The linker can be cleavable or non-cleavable. Each of the duplexes can target the same gene or two different genes; or each of the duplexes can target same gene at two different target sites.

In one embodiment, two RNAi agents represented by at least one of formulas (VI), (VIa), (VIb), (VIc), and (VId) are linked to each other at the 5' end, and one or both of the 3' ends.

In some embodiments, any one of the RNAi agents (e.g., CYP7A1 RNAi agents) described herein comprises ten or fewer nucleosides with a 2'-F modification. For example, the RNAi agent may contain 10, 9, 8, 7, 6, 5, 4, 3, 2, 1 or 0 nucleosides with a 2'-F modification. In some embodiments, any one of the RNAi agents (e.g., CYP7A1 RNAi agents) described herein comprises ten 2'-F modified nucleosides, e.g., four 2'-F modified nucleosides in the sense strand and six 2'-F modified nucleosides in the antisense strand. In some embodiments, any one of the RNAi agents (e.g., CYP7A1 RNAi agents) described herein comprises six 2'-F modified nucleosides, e.g., four 2'-F modified nucleosides in the sense strand and two 2'-F modified nucleosides in the antisense strand. In some embodiments, any one of the RNAi agents (e.g., CYP7A1 RNAi agents) described herein comprises eight 2'-F modified nucleosides, e.g., four 2'-F modified nucleosides in the sense strand and four 2'-F modified nucleosides in the antisense strand. In some embodiments, the rest of the nucleosides in the sense strand and the antisense strand that are not 2'-F modified nucleosides are 2'-O-Me modified nucleosides.

In some embodiments, any one of the RNAi agents (e.g., CYP7A1 RNAi agents) described herein comprises a sense strand and an antisense strand, wherein the sense strand is 21 nucleosides in length, wherein the nucleosides at positions 7, 9, 10, and 11 (counting 5'→3') of the sense strand are 2'-F modified nucleosides and wherein the nucleosides at positions 1, 2, 3, 4, 5, 6, 8, 12, 13, 14, 15, 16, 17, 18, 19, 20, and 21 (counting 5'→3') of the sense strand are 2'-O-Me modified nucleosides, wherein the antisense strand is 23 nucleosides in length, wherein the nucleosides at positions 2, 6, 8, 9, 14, and 16 (counting 5'→3') of the antisense strand are 2'-F modified nucleosides, wherein the nucleosides at positions 1, 3, 4, 5, 7, 10, 11, 12, 13, 15, 17, 18, 19, 20, 21, 22, and 23 (counting 5'→3') of the antisense strand are 2'-O-Me modified nucleosides, and wherein the first two internucleoside linkages of the sense strand (counting 5'→3') are phosphorothioate internucleoside linkages and wherein the first two and last two internucleoside linkages of the antisense strand (counting 5'→3') are phosphorothioate internucleoside linkages, and wherein the RNAi agent has a two nucleoside overhang at the 3'-end of the antisense strand, and a blunt end at the 5'-end of the antisense strand.

In some embodiments, any one of the RNAi agents (e.g., CYP7A1 RNAi agents) described herein comprises a sense strand and an antisense strand, wherein the sense strand is 21 nucleosides in length, wherein the nucleosides at positions 7, 9, 10, and 11 (counting 5'→3') of the sense strand are 2'-F modified nucleosides and wherein the nucleosides at positions 1, 2, 3, 4, 5, 6, 8, 12, 13, 14, 15, 16, 17, 18, 19, 20, and 21 (counting 5'→3') of the sense strand are 2'-O-Me modified nucleosides, wherein the antisense strand is 23 nucleosides in length, wherein the nucleosides at positions 2, 6, 14, and 16 (counting 5'→3') of the antisense strand are 2'-F modified nucleosides, wherein the nucleosides at positions 1, 3, 4, 5, 7, 8, 9, 10, 11, 12, 13, 15, 17, 18, 19, 20, 21, 22, and 23 (counting 5'→3') of the antisense strand are 2'-O-Me modified nucleosides, and wherein the first two internucleoside linkages of the sense strand (counting 5'→3') are phosphorothioate internucleoside linkages and wherein the first two and last two internucleoside linkages of the antisense strand (counting 5'→3') are phosphorothioate internucleoside linkages, and wherein the RNAi agent has a two nucleoside overhang at the 3'-end of the antisense strand, and a blunt end at the 5'-end of the antisense strand.

In some embodiments, any one of the RNAi agents (e.g., CYP7A1 RNAi agents) described herein can be optimized for RNA interference by incorporating thermally destabilizing modifications at one or more positions selected from positions 2, 3, 4, 5, 6, 7, 8, and 9 (counting 5'→3') of the 5'-end of the antisense strand to reduce or inhibit off-target gene silencing. In some embodiments, the antisense strand comprises at least one (e.g., one, two, three, four, five or more) thermally destabilizing modification of the duplex within the first 9 nucleoside positions (counting 5'→3') of the antisense strand. Such thermally destabilizing modifications are described, for example, in U.S. Pat. No. 10,233,448 and 11,504,391. In some embodiments, any one of the RNAi agents (e.g., CYP7A1 RNAi agents) described herein comprises thermally destabilizing modifications as described in U.S. Pat. No. 10,233,448 and 11,504,391. In some embodiments, the thermally destabilizing modification is an abasic modification, mismatch with the opposing nucleoside in the duplex, or a sugar modification (e.g., a 2'-deoxy nucleoside or acyclic nucleoside e.g., unlocked nucleic acids (UNA) or glycerol nucleic acid (GNA)). In some embodiments, the thermally destabilizing modification is a GNA. In some embodiments, the antisense strand comprises at least one (e.g., one, two, three, four, five or more) GNA within the first 9 nucleoside positions (counting 5'→3') of the antisense strand.

In some embodiments, any one of the RNAi agents (e.g., CYP7A1 RNAi agents) described herein comprises a sense strand and an antisense strand, wherein the sense strand is 21 nucleosides in length, wherein the nucleosides at positions 7, 9, 10, and 11 (counting 5'→3') of the sense strand are 2'-F modified nucleosides and wherein the nucleosides at positions 1, 2, 3, 4, 5, 6, 8, 12, 13, 14, 15, 16, 17, 18, 19, 20, and 21 (counting 5'→3') of the sense strand are 2'-O-Me modified nucleosides, wherein the antisense strand is 23 nucleosides in length, wherein the nucleosides at positions 2, 6, 8, 9, 14, and 16 (counting 5'→3') of the antisense strand are 2'-F modified nucleosides, wherein the nucleosides at positions 1, 3, 4, 5, 10, 11, 12, 13, 15, 17, 18, 19, 20, 21, 22, and 23 (counting 5'→3') of the antisense strand are 2'-O-Me modified nucleosides, wherein the nucleoside at position 7 of the antisense strand is a glycol modified nucleoside (GNA), and wherein the first two internucleoside linkages of the sense strand (counting 5'→3') are phosphorothioate internucleoside linkages and wherein the first two and last two internucleoside linkages of the antisense strand (counting 5'→3') are phosphorothioate internucleoside linkages, and wherein the RNAi agent has a two nucleoside overhang at the 3'-end of the antisense strand, and a blunt end at the 5'-end of the antisense strand.

In some embodiments, any one of the RNAi agents (e.g., CYP7A1 RNAi agents) described herein comprises a sense strand and an antisense strand, wherein the nucleoside at the 3'-end of the sense strand is a deoxy nucleoside (e.g., deoxy-thymine (dT)) or the nucleoside at the 3'-end of the antisense strand is a deoxy nucleoside (e.g., dT). For example, in some embodiments, there is a short sequence of dT nucleosides, for example, two dT nucleosides on the 3'-end of the sense, antisense strand, or both strands. In some embodiments there is one dT nucleoside at the 3'-end of the sense, antisense strand, or both strands. In some embodiments, the dT nucleoside is an inverted dT nucleoside.

In some embodiments, any one of the RNAi agents (e.g., CYP7A1 RNAi agents) described herein comprises a sense strand and an antisense strand, wherein the sense strand is 21 nucleosides in length, wherein the nucleosides at positions 7 and 9 (counting 5'→3') of the sense strand are 2'-F modified nucleosides, wherein the nucleosides at positions 1, 2, 3, 4, 5, 6, 8, 10, 12, 13, 14, 15, 16, 17, 18, 19, 20, and 21 (counting 5'→3') of the sense strand are 2'-O-Me modified nucleosides, and wherein the nucleoside at position 11 (counting 5'→3') is a deoxy nucleoside (e.g. dT), wherein the antisense strand is 23 nucleosides in length, wherein the nucleosides at positions 2, 4, 5, 6, 8, 10, 12, 14, 16, and 18 (counting 5'→3') of the antisense strand are 2'-F modified nucleosides, wherein the nucleosides at positions 1, 3, 7, 9, 11, 13, 15, 17, 19, 20, 21, 22, and 23 (counting 5'→3') of the antisense strand are 2'-O-Me modified nucleosides, wherein the first two internucleoside linkages of the sense strand (counting 5'→3') are phosphorothioate internucleoside linkages, wherein the first two and last two internucleoside linkages of the antisense strand (counting 5'→3') are phosphorothioate internucleoside linkages, and wherein the RNAi agent has a two nucleoside overhang at the 3'-end of the antisense strand, and a blunt end at the 5'-end of the antisense strand.

In some embodiments, any one of the RNAi agents (e.g., CYP7A1 RNAi agents) described herein comprises a sense strand and an antisense strand, wherein the sense strand is 21 nucleosides in length, wherein the nucleosides at positions 3, 5, 7, 9, 10, 11, 13, 16, and 18 (counting 5'→3') of the sense strand are 2'-F modified nucleosides and wherein the nucleosides at positions 1, 2, 4, 6, 8, 12, 14, 15, 17, 19, 20, and 21 (counting 5'→3') of the sense strand are 2'-O-Me modified nucleosides, wherein the antisense strand is 25 nucleosides in length, wherein the nucleosides at positions 2, 3, 5, 8, 10, 14, 16, and 18 (counting 5'→3') of the antisense strand are 2'-F modified nucleosides, wherein the nucleosides at positions 1, 4, 6, 7, 9, 11, 12, 13, 15, 17, 19, 20, 21, 22, and 23 (counting 5'→3') of the antisense strand are 2'-O-Me modified nucleosides, wherein the nucleosides at position 24 and 25 (counting 5'→3') are deoxy nucleosides (e.g. dT), wherein the first two internucleoside linkages of the sense strand (counting 5'→3') are phosphorothioate internucleoside linkages, wherein the internucleoside linkages between positions 21 and 22 and between positions 22 and 23 of the antisense strand (counting 5'→3') are phosphorothioate internucleoside linkages, and wherein the RNAi agent has a four nucleoside overhang at the 3'-end of the antisense strand, and a blunt end at the 5'-end of the antisense strand.

In some embodiments, any one of the RNAi agents (e.g., CYP7A1 RNAi agents) described herein comprises a sense strand and an antisense strand, wherein the sense strand is 21 nucleosides in length, wherein the nucleosides at positions 1, 3, 5, 7, 9, 10, 11, 13, 17, 19, and 21 (counting 5'→3') of the sense strand are 2'-F modified nucleosides and wherein the nucleosides at positions 2, 4, 6, 8, 12, 14, 15, 16, 18, and 20 (counting 5'→3') of the sense strand are 2'-O-Me modified nucleosides, wherein the antisense strand is 23 nucleosides in length, wherein the nucleosides at positions 2, 4, 6, 7, 8, 10, 14, 16, 18, 20, and 22 (counting 5'→3') of the antisense strand are 2'-F modified nucleosides, wherein the nucleosides at positions 1, 3, 5, 9, 11, 12, 13, 15, 17, 19, 21, and 23 (counting 5'→3') of the antisense strand are 2'-O-Me modified nucleosides, wherein the last two internucleoside linkages of the antisense strand (counting 5'→3') are phosphorothioate internucleoside linkages, and wherein the RNAi agent has a two nucleoside overhang at the 3'-end of the antisense strand, and a blunt end at the 5'-end of the antisense strand.

In some embodiments, any one of the RNAi agents (e.g., CYP7A1 RNAi agents) described herein comprises a sense strand and an antisense strand, wherein the sense strand is 21 nucleosides in length, wherein the nucleosides at positions 7, 9, 11, 13, and 15 (counting 5' →3') of the sense strand are 2'-F modified nucleosides and wherein the nucleosides at positions 1, 2, 3, 4, 5, 6, 8, 10, 12, 14, 16, 17, 18, 19, 20, and 21 (counting 5'→3') of the sense strand are 2'-O-Me modified nucleosides, wherein the antisense strand is 23 nucleosides in length, wherein the nucleosides at positions 2, 3, 4, 6, 8, 10, 12, 14, 16, 18, and 20 (counting 5'→3') of the antisense strand are 2'-F modified nucleosides, wherein the nucleosides at positions 1, 5, 7, 9, 11, 13, 15, 17, 19, 21, 22, and 23 (counting 5'→3') of the antisense strand are 2'-O-Me modified nucleosides, wherein the first two internucleoside linkages of the sense strand (counting 5'→3') are phosphorothioate internucleoside linkages, wherein the first two and last two internucleoside linkages of the antisense strand (counting 5'→3') are phosphorothioate internucleoside linkages, and wherein the RNAi agent has a two nucleoside overhang at the 3'-end of the antisense strand, and a blunt end at the 5'-end of the antisense strand.

In some embodiments, any one of the RNAi agents (e.g., CYP7A1 RNAi agents) described herein comprises a sense strand and an antisense strand, wherein the sense strand is 21 nucleosides in length, wherein the nucleosides at positions 10 and 11 (counting 5'→3') of the sense strand are 2'-F modified nucleosides and wherein the nucleosides at positions 1, 2, 3, 4, 5, 6, 7, 8, 9, 12, 13, 14, 15, 16, 17, 18, 19, 20, and 21 (counting 5'→3') of the sense strand are 2'-O-Me modified nucleosides, wherein the antisense strand is 23 nucleosides in length, wherein the nucleosides at positions 2, 4, 6, 8, 10, 14, 16, 18, and 20 (counting 5'→3') of the antisense strand are 2'-F modified nucleosides, wherein the nucleosides at positions 1, 3, 5, 7, 9, 11, 12, 13, 15, 17, 19, 21, 22, and 23 (counting 5'→3') of the antisense strand are 2'-O-Me modified nucleosides, wherein the first two internucleoside linkages of the sense strand (counting 5'→3') are phosphorothioate internucleoside linkages, wherein the first two and last two internucleoside linkages of the antisense strand (counting 5'→3') are phosphorothioate internucleoside linkages, and wherein the RNAi agent has a two nucleoside overhang at the 3'-end of the antisense strand, and a blunt end at the 5'-end of the antisense strand.

In some embodiments, any one of the RNAi agents (e.g., CYP7A1 RNAi agents) described herein comprises a sense strand and an antisense strand, wherein the sense strand is 21 nucleosides in length, wherein the nucleosides at positions 1, 3, 5, 7, 9, 10, 11, and 13 (counting 5'→3') of the sense strand are 2'-F modified nucleosides and wherein the nucleosides at positions 2, 4, 6, 8, 12, 14, 15, 16, 17, 18, 19, 20, and 21 (counting 5'→3') of the sense strand are 2'-O-Me modified nucleosides, wherein the antisense strand is 23 nucleosides in length, wherein the nucleosides at positions 2, 4, 8, 10, 14, 16, and 20 (counting 5'→3') of the antisense strand are 2'-F modified nucleosides, wherein the nucleosides at positions 1, 3, 5, 6, 7, 9, 11, 12, 13, 15, 17, 18, 19, 21, 22, and 23 (counting 5'→3') of the antisense strand are 2'-O-Me modified nucleosides, wherein the first two internucleoside linkages of the sense strand (counting 5'→3') are phosphorothioate internucleoside linkages, wherein the first two and last two internucleoside linkages of the antisense strand (counting 5'→3') are phosphorothioate internucleoside linkages, and wherein the RNAi agent has a two nucleoside overhang at the 3'-end of the antisense strand, and a blunt end at the 5'-end of the antisense strand.

In some embodiments, any one of the RNAi agents (e.g., CYP7A1 RNAi agents) described herein comprises a sense strand and an antisense strand, wherein the sense strand is 21 nucleosides in length, wherein the nucleosides at positions 7, 9, 10, and 11 (counting 5'→3') of the sense strand are 2'-F modified nucleosides and wherein the nucleosides at positions 1, 2, 3, 4, 5, 6, 8, 12, 13, 14, 15, 16, 17, 18, 19, 20, and 21 (counting 5'→3') of the sense strand are 2'-O-Me modified nucleosides, wherein the antisense strand is 23 nucleosides in length, wherein the nucleosides at positions 2, 6, 9, 14, and 16 (counting 5'→3') of the antisense strand are 2'-F modified nucleosides, wherein the nucleosides at positions 1, 3, 4, 5, 7, 8, 10, 11, 12, 13, 15, 17, 18, 19, 20, 21, 22, and 23 (counting 5'→3') of the antisense strand are 2'-O-Me modified nucleosides, and wherein the first two internucleoside linkages of the sense strand (counting 5'→3') are phosphorothioate internucleoside linkages and wherein the first two and last two internucleoside linkages of the antisense strand (counting 5'→3') are phosphorothioate internucleoside linkages, and wherein the RNAi agent has a two nucleoside overhang at the 3'-end of the antisense strand, and a blunt end at the 5'-end of the antisense strand.

In some embodiments, any one of the RNAi agents (e.g., CYP7A1 RNAi agents) described herein comprises a sense strand and an antisense strand, wherein the sense strand is 19 nucleosides in length, wherein the nucleosides at positions 5, 7, 8, and 9 (counting 5'→3') of the sense strand are 2'-F modified nucleosides and wherein the nucleosides at positions 1, 2, 3, 4, 6, and 10, 11, 12, 13, 14, 15, 16, 17, 18, and 19 (counting 5'→3') of the sense strand are 2'-O-Me modified nucleosides, wherein the antisense strand is 21 nucleosides in length, wherein the nucleosides at positions 2, 6, 8, 9, 14, and 16 (counting 5'→3') of the antisense strand are 2'-F modified nucleosides, wherein the nucleosides at positions 1, 3, 4, 5, 7, 10, 11, 12, 13, 15, 17, 18, 19, 20, and 21 (counting 5'→3') of the antisense strand are 2'-O-Me modified nucleosides, and wherein the first two internucleoside linkages of the sense strand (counting 5'→3') are phosphorothioate internucleoside linkages and wherein the first two and last two internucleoside linkages of the antisense strand (counting 5'→3') are phosphorothioate internucleoside linkages, and wherein the RNAi agent has a two nucleoside overhang at the 3'-end of the antisense strand, and a blunt end at the 5'-end of the antisense strand.

In some embodiments, any one of the RNAi agents (e.g., CYP7A1 RNAi agents) described herein comprises the chemical modifications and/or modification patterns as described in U.S. Pat. Nos. 10,676,742, 11,661,604, and 11,655,473. For example, in some embodiments, an RNAi agent (e.g., a CYP7A1 RNAi agent described herein) comprises a sense strand and an antisense strand, wherein the sense strand comprises a mix of different 2'-modified nucleosides (e.g., 2'-F modified nucleosides and 2'-O-Me modified nucleosides). In some embodiments, an RNAi agent (e.g., a CYP7A1 RNAi agent described herein) comprises a sense strand and an antisense strand, wherein the nucleosides at three consecutive positions of the sense strand are 2'-F modified nucleosides. In some embodiments, an RNAi agent (e.g., a CYP7A1 RNAi agent described herein) comprises a sense strand and an antisense strand, wherein the nucleosides at positions 9, 10, and 11 (counting 5'→3') of the sense strand are 2'-F modified nucleosides. In some embodiments, an RNAi agent (e.g., a CYP7A1 RNAi agent described herein) comprises a sense strand and an antisense strand, wherein the nucleosides at positions 9, 10, and 11 (counting 5'→3') of the sense strand are 2'-F modified nucleosides and the nucleosides at positions 8 and 12 (counting 5'→3') are not 2'-F modified nucleosides, e.g., are 2'-O-Me modified nucleosides. In some embodiments, an RNAi agent (e.g., a CYP7A1 RNAi agent described herein) comprises a sense strand and an antisense strand, wherein the nucleosides at positions 9, 10, and 11 (counting 5'→3') of the sense strand are 2'-F modified nucleosides and the nucleosides at positions 8 and 12 (counting 5'→3') are 2'-O-Me modified nucleosides. In some embodiments, the rest of the nucleosides in the sense strand are a mix of 2'-F modified nucleosides and 2'-O-Me modified nucleosides. In some embodiments, an RNAi agent (e.g., a CYP7A1 RNAi agent described herein) comprises a sense strand and an antisense strand, wherein the nucleosides at positions 9, 10, and 11 (counting 5'→3') of the sense strand are 2'-F modified nucleosides and the nucleosides at positions 8 and 12 (counting 5'→3') are 2'-O-Me modified nucleosides and the rest of the nucleosides in the sense strand comprise alternating motifs of 2'-O-Me modified nucleosides and 2'-F modified nucleosides.

In some embodiments, an RNAi agent (e.g., a CYP7A1 RNAi agent described herein) comprises a sense strand and an antisense strand, wherein the antisense strand comprises a mix of different 2'-modified nucleosides (e.g., any combination of 2'-F modified nucleosides, 2'-deoxy nucleosides, and 2'-O-Me modified nucleosides). In some embodiments, an RNAi agent (e.g., a CYP7A1 RNAi agent described herein) comprises a sense strand and an antisense strand, wherein the nucleosides at one or more of positions 2, 12, 16, 18, 20, and 21 (counting 5'→3') of the antisense strand are 2'-deoxy nucleosides. In some embodiments, an RNAi agent (e.g., a CYP7A1 RNAi agent described herein) comprises a sense strand and an antisense strand, wherein the nucleosides at positions 2, 12, 16, 18, 20, and 21 (counting 5'→3') of the antisense strand are 2'-deoxy nucleosides and the rest of the nucleosides in the antisense strand are not 2'-deoxy nucleosides, e.g., are 2'-O-Me modified nucleosides or 2'-F modified nucleosides. In some embodiments, an RNAi agent (e.g., a CYP7A1 RNAi agent described herein) comprises a sense strand and an antisense strand, wherein the nucleosides at positions 1, 3, 4, 5, 6, 7, 8, 9, 10, 11, 13, 14, 15, 17, and 19 of the antisense strand are a mix of 2'-F modified nucleosides and 2'-O-Me modified nucleosides. In some embodiments, the nucleosides at positions 3, 4, 5, 6, 7, 8, 9, 10, and 11 of the antisense strand comprise alternating motifs of 2'-O-Me modified nucleosides and 2'-F modified nucleosides.

In some embodiments, any one of the RNAi agents (e.g., CYP7A1 RNAi agents) described herein further comprises one or more (e.g., 1, 2, 3, 4, 5, or 6) phosphorothioate internucleoside linkages in the antisense strand. In some embodiments, any one of the RNAi agents (e.g., CYP7A1 RNAi agents) described herein further comprises six phosphorothioate internucleoside linkages in the antisense strand. In some embodiments, any one of the RNAi agents (e.g., CYP7A1 RNAi agents) described herein does not comprise any phosphorothioate internucleoside linkages in the sense strand. In some embodiments, any one of the RNAi agents (e.g., CYP7A1 RNAi agents) described herein further comprises six phosphorothioate internucleoside linkages in the antisense strand (e.g., the first two internucleoside linkages and the last two internucleoside linkages counting 5'→3' and the internucleoside linkages between nucleosides at positions 15-16 and 17-18 counting 5'→3') and no phosphorothioate internucleoside linkages in the sense strand. It is to be understood that, in any one of the RNAi agents (e.g., CYP7A1 RNAi agents) described herein, the rest of the internucleoside linkages, unless otherwise specified, are all phosphodiester internucleoside linkages.

In some embodiments, any one of the RNAi agents (e.g., CYP7A1 RNAi agents) described herein comprises a sense strand and an antisense strand, wherein the nucleosides at positions 1, 3, 5, 7, 9, 10, 11, 13, 15, 17, and 19 (counting 5'→3') of the sense strand are 2'-F modified nucleosides, wherein the nucleosides at positions 3, 5, 7, 9, 11, 14, 17, and 19 (counting 5'→3') of the antisense strand are 2'-F modified nucleosides, wherein the nucleosides at positions 2, 12, 16, 18, 20, and 21 (counting 5'→3') of the antisense strand are 2'-deoxy nucleosides, wherein all nucleosides of the antisense strand and the sense strand that are not 2'-F modified nucleosides or 2'-deoxy nucleosides are 2'-O-Me modified nucleosides, and wherein the first two and the last two internucleoside linkages of the antisense strand (counting 5'→3') and the internucleoside linkages between positions 15-16 and 17-18 of the antisense strand (counting 5'→3') are phosphorothioate internucleoside linkages.

In some embodiments, any one of the RNAi agents (e.g., CYP7A1 RNAi agents) described herein comprises a sense strand and an antisense strand, wherein nucleosides at positions 8, 9, 10, and 11 of the sense strand are 2'-F modified nucleosides and nucleosides at positions 2, 3, 4, 5, 7, 10, and 14 of the antisense strand are 2'-F modified nucleosides, wherein the rest of the nucleosides in the sense strand and antisense strand are 2'-O-Me modified nucleosides, wherein the first two or first three internucleoside linkages of the antisense strand (counting 5'→3') are phosphorothioate internucleoside linkages.

In some embodiments, any one of the RNAi agents (e.g., CYP7A1 RNAi agents) described herein comprises a sense strand and an antisense strand, wherein nucleosides at one or more of positions 3, 5, 8, 9, 10, 11, 13, 15, or 17 (counting 5'→3') of the sense strand are 2'-F modified nucleosides. In some embodiments, nucleosides at one or more of positions 1, 2, 4, 6, 7, 12, 14, 16, 18, 19, or 20 (counting 5'→3') of the sense strand are 2'-O-Me modified nucleosides. In some embodiments, nucleosides at one or more of positions 2, 3, 4, 5, 7, 9, 10, 14, 16, or 18 (counting 5'→3') of the antisense strand are 2'-F modified nucleosides. In some embodiments, nucleosides at one or more of positions 1, 6, 8, 11, 12, 13, 15, 17, 19, 20, 21, or 22 (counting 5'→3') of the antisense strand are 2'-O-Me modified nucleosides.

In some embodiments, nucleosides at all of positions 3, 5, 8, 9, 10, 11, 13, 15, or 17 (counting 5'→3') of the sense strand are 2'-F modified nucleosides and the rest of the nucleosides in the sense strand are 2'-O-Me modified nucleosides. In some embodiments, nucleosides at all of positions 2, 3, 4, 5, 7, 9, 10, 14, 16, and 18 (counting 5'→3') of the antisense strand are 2'-F modified nucleosides and the rest of the nucleosides in the antisense strand are 2'-O-Me modified nucleosides. In some embodiments, the first internucleoside linkage of the sense strand (counting 5'→3') is a phosphorothioate internucleoside linkage and the first three and last two internucleoside linkages of the antisense strand (counting 5'→3') are phosphorothioate internucleoside linkages. In some embodiments, nucleosides at all of positions 3, 5, 8, 9, 10, 11, 13, 15, or 17 (counting 5'→3') of the sense strand are 2'-F modified nucleosides and all of positions 2, 3, 4, 5, 7, 9, 10, 14, 16, and 18 (counting 5'→3') of the antisense strand are 2'-F modified nucleosides, and the rest of the nucleosides in the sense strand and antisense strand are 2'-O-Me modified nucleosides, wherein the first internucleoside linkage of the sense strand (counting 5'→3') is a phosphorothioate internucleoside linkage and the first three and last two internucleoside linkages of the antisense strand (counting 5'→3') are phosphorothioate internucleoside linkages.

In some embodiments, any one of the RNAi agents (e.g., CYP7A1 RNAi agents) described herein comprises a sense strand and an antisense strand, wherein the antisense strand comprises a phosphorylated nucleoside at the 5' terminus, wherein the phosphorylated nucleoside is selected from uridine and adenosine. In some embodiments, the phosphorylated nucleoside is uridine. In some embodiments, the 5'-nucleoside of the antisense strand comprises a 4'-phosphate analog. In some embodiments, the phosphate analog is oxymethylphosphonate, vinylphosphonate, or malonylphosphonate. In some embodiments, the phosphate analog is a 4'-phosphate analog comprising 5'-methoxyphosphonate-4'-oxy.

Conjugated CYP7A1 RNAi Agents

In some embodiments, any one of the RNAi agents described herein is conjugated (e.g., covalently linked) to another chemical moiety (e.g., a targeting moiety for, e.g., improved delivery, cellular uptake and distribution). In some embodiments, any one of the RNAi agents described herein is conjugated (e.g., covalently linked) to a targeting moiety via a linker. Any of the linkers described herein may be used. In some embodiments, the targeting moiety is conjugated (e.g., covalently linked) to the 5' end of the antisense strand of an RNAi agent. In some embodiments, the targeting moiety is conjugated (e.g., covalently linked) to the 3' end of the antisense strand of an RNAi agent. In some embodiments, the targeting moiety is conjugated (e.g., covalently linked) to the 5' end of the sense strand of an RNAi agent. In some embodiments, the targeting moiety is conjugated (e.g., covalently linked) to the 3' end of the sense strand of an RNAi agent.

Any suitable targeting moiety in the field of RNA interference may be conjugated (e.g., covalently linked) to any one of the RNAi agents described herein. Non-limiting examples of targeting moieties include carbohydrates (e.g., monosaccharides (such as GalNAc)), disaccharides, trisaccharides, tetrasaccharides, polysaccharides), folate, mannose-6P, clusters of sugars such as GalNAc cluster, mannose cluster, galactose cluster, an aptamer, integrin receptor ligands, chemokine receptor ligands, transferrin, biotin, asialoglycoprotein receptor ligands, serotonin receptor ligands, PSMA, endothelin, GCPII, somatostatin, LDL and HDL ligands.

In some embodiments, the targeting moiety is an antibody or antigen binding fragment thereof that specifically binds to a cell surface protein, e.g., a cell surface receptor that promotes receptor mediated endocytosis and internalization of the RNAi agents described herein. Cell surface proteins that may be targeted by the targeting moiety include, without limitation: asialoglycoprotein receptors, CD63, MHC-I, Kremen-1, Kremen-2, LRP5, LRP6, LRP8, transferrin receptor, LDL-receptor, LDL-related protein 1 receptor, ASGR1, ASGR2, amyloid precursor protein-like protein-2 (APLP2), apelin receptor (APL R), PRLR (prolactin receptor), MAL (Myelin And Lymphocyte protein, a.k.a. VIP 17), IGF2R, vacuolar-type H+ ATPase, diphtheria toxin receptor, folate receptor, glutamate receptors, glutathione receptor, leptin receptors, scavenger receptors, SCARAl-5, SCARBI-3, CD36, CDH16 (Cadheri-16), CLDN16 (Claudn-16), KL (Klotho), PTH1R (parathyroid hormone receptor), SLC22A13 (Solute carrier family 22 member 13), SLC5A2 (Sodium/glucose cotransporter 2), UMOD (Uromodulin), BMPRIA (Bone morphogenetic protein receptor 1A), m-cadherin, CD9, MuSK (muscle-specific kinase), LGR4/GPR48 (G protein-coupled receptor 48), cholinergic receptor (nicotinic) alpha 1, CDH15 (Cadheri-15), ITGA7 (Integrin alpha-7), CACNG1 (L-type calcium channel subunit gamma-1), CACNA1s (L-type calcium channel subunit alpha-15), CACNG6 (L-type calcium channel subunit gamma-6), SCN1B (Sodium channel subunit beta-1), CHRNA1 (ACh receptor subunit alpha), CHRND (ACh receptor subunit delta), LRRC14B (Leucine-rich repeat-containing protein 14B), and POPDC3 (Popeye domain-containing protein 3). In some embodiments, antibodies or antigen binding fragments that may be used as a targeting moiety according to the present disclosure is a Fab fragment, a Fab', a F(ab')2 fragment, a Fv fragment, a scFv, a VHH, or a diabody. In some embodiments, the antibody or antigen binding fragment thereof is covalently linked directly or indirectly (e.g., via a linker) to an RNAi agent described herein.

In some embodiments, the targeting moiety is a hepatospecific targeting moiety (i.e., it directs the RNAi agent composition to liver cells). In some embodiments, the targeting moiety comprises a monosaccharide. In some embodiments, the monosaccharide is an N-acetylgalactosamine (GalNAc). In some embodiments, the targeting moiety comprises one or more (e.g, 1, 2, 3, 4, or more) GalNAc. In some embodiments, the one or more GalNAc in the targeting moiety are linked via phosphorothioate linkages. In some embodiments, the GalNAc targeting moiety serves as a ligand that targets the RNAi agent to particular cells. In some embodiments, the GalNAc targeting moiety targets the RNAi agent to liver cells, e.g., by serving as a ligand for the asialoglycoprotein receptor of liver cells (e.g., hepatocytes). GalNAc targeting moieties, which comprise one or more GalNAc, have been described, for example, in the following references:

| Reference No. | Application No. | Filing Date |
|---|---|---|
| U.S. Pat. No. 8,106,022 | U.S. Pat. No. 12/328,528 | Dec. 4, 2008 |
| U.S. Pat. No. 10,246,709 | U.S. Pat. No. 15/452,423 | Mar. 7, 2017 |
| U.S. Pat. No. 5,994,517 | U.S. Pat. No. 08/755,062 | Nov. 22, 1996 |
| U.S. Pat. No. 6,906,182 | U.S. Pat. No. 09/998,497 | Nov. 30, 2001 |
| U.S. Pat. No. 10,294,474 | U.S. Pat. No. 15/452,324 | Mar. 7, 2017 |
| U.S. Pat. No. 2017305956 | U.S. Pat. No. 15/621,395 | Jun. 13, 2017 |
| U.S. Pat. No. 10,233,448 | U.S. Pat. No. 15/504,855 | Feb. 17, 2017 |
| U.S. Pat. No. 2016122761 | U.S. Pat. No. 14/898,873 | Jun. 23, 2014 |
| U.S. Pat. No. 10,808,246 | U.S. Pat. No. 14/901,945 | Dec. 29, 2015 |
| WO 2022/159158A1 | PCT/US2021/057016 | Oct. 28, 2021 |

The disclosures in these references related to GalNAc are hereby incorporated herein by reference.

In some embodiments, a targeting moiety comprises the structure below:

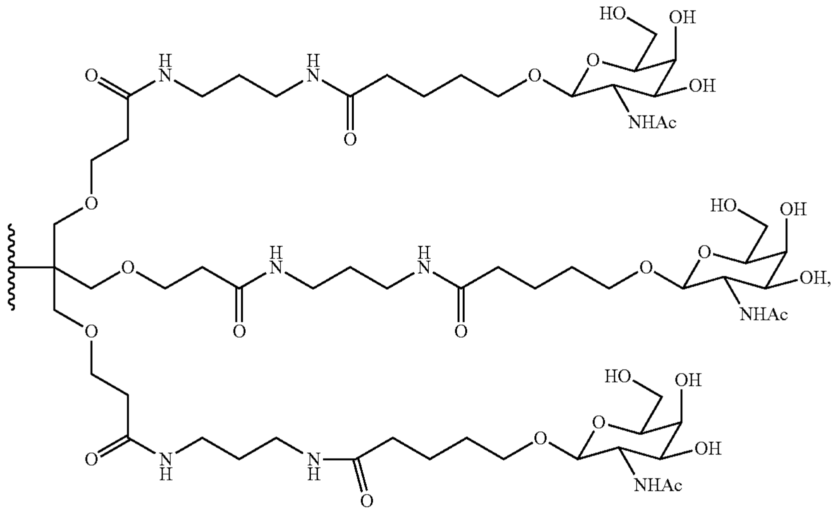 [SMILES: *C(COCCC(=O)NCCCNC(=O)CCCCOC1OC(CO)C(O)C(O)C1NC(C)=O)(COCCC(=O)NCCCNC(=O)CCCCOC1OC(CO)C(O)C(O)C1NC(C)=O)COCCC(=O)NCCCNC(=O)CCCCOC1OC(CO)C(O)C(O)C1NC(C)=O]

or a pharmaceutically acceptable salt thereof.

In some embodiments a targeting moiety comprises the structure below:

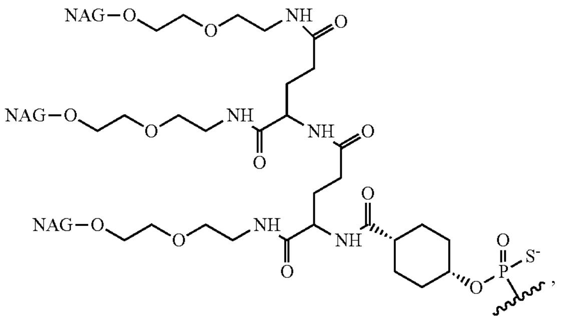

or a pharmaceutically acceptable salt thereof.

In some embodiments, a targeting moiety comprises the structure below:

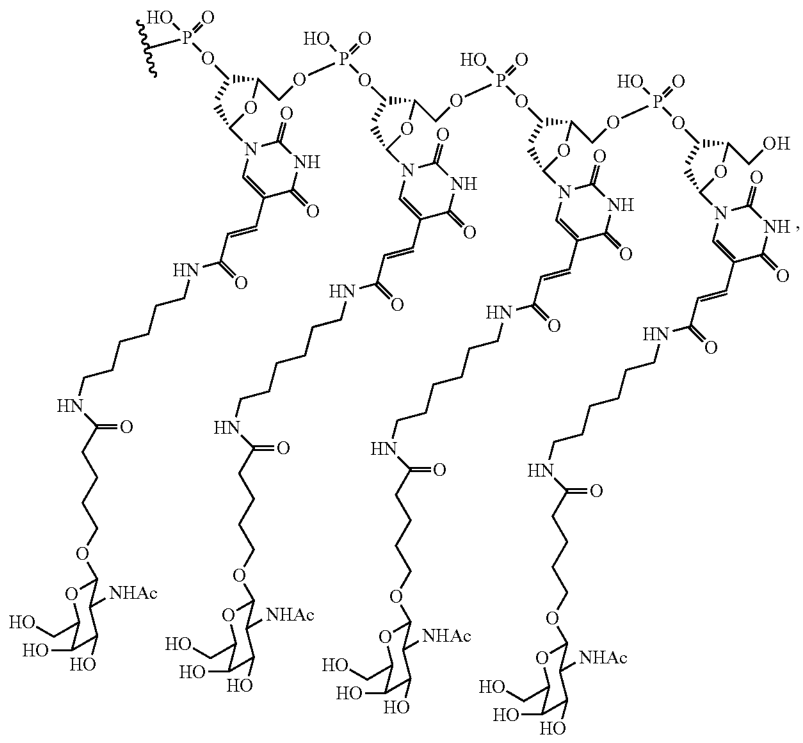 [SMILES: *P(=O)(O)O[C@H]1C[C@@H](n2cc(/C=C/C(=O)NCCCCCCNC(=O)CCCCOC3OC(CO)C(O)C(O)C3NC(C)=O)c(=O)[nH]c2=O)O[C@H]1COP(=O)(O)O[C@H]1C[C@@H](n2cc(/C=C/C(=O)NCCCCCCNC(=O)CCCCOC3OC(CO)C(O)C(O)C3NC(C)=O)c(=O)[nH]c2=O)O[C@H]1COP(=O)(O)O[C@H]1C[C@@H](n2cc(/C=C/C(=O)NCCCCCCNC(=O)CCCCOC3OC(CO)C(O)C(O)C3NC(C)=O)c(=O)[nH]c2=O)O[C@H]1COP(=O)(O)O[C@H]1C[C@@H](n2cc(/C=C/C(=O)NCCCCCCNC(=O)CCCCOC3OC(CO)C(O)C(O)C3NC(C)=O)c(=O)[nH]c2=O)O[C@H]1CO]

or a pharmaceutically acceptable salt thereof.

In some embodiments, an RNAi agent is conjugated to the targeting moiety via a tether, also referred to as a linker. A non-limiting example of a tether includes a linear aliphatic group comprising one or more groups selected from alkyl, substituted alkyl, ether, thioether, disulfide, amide and polyethylene glycol (PEG) groups in any combination. In some embodiments, a targeting moiety covalently linked to a tether shown below:

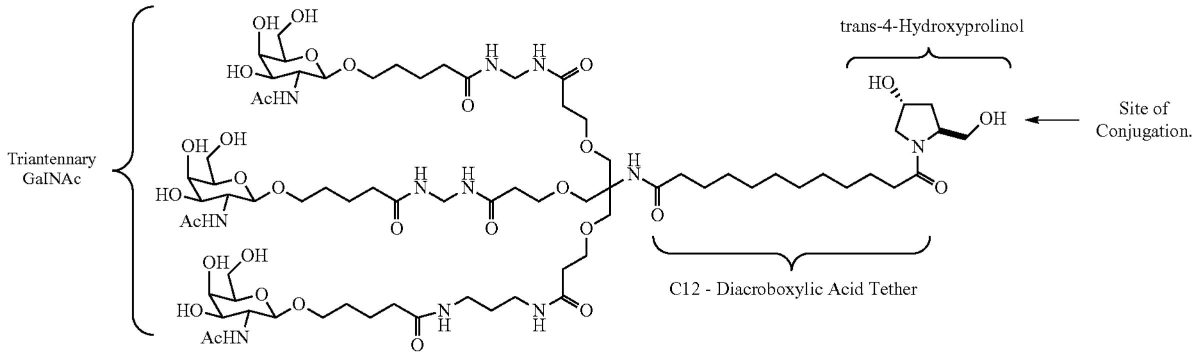

Additional carbohydrate conjugates and linkers suitable for use in the present invention include those described in U.S. Pat. Nos. 9,127,276, 9,145,558, and 10,683,499. Disclosures in U.S. Pat. No. 9,127,276 (U.S. patent application Ser. No. 14/267,842 filed May 1, 2014), 9,145,558 (U.S. patent application Ser. No. 14/633,491 filed Feb. 27, 2015), and 10,683,499 (U.S. patent application Ser. No. 15/687,306 filed Aug. 25, 2017) regarding carbohydrate conjugates and linkers are incorporated herein by reference.

Some aspects of the present disclosure further provide additional targeting moieties comprising one or more GalNAc and structures that may be conjugated to any one of the CYP7A1 RNAi agents described herein. In some embodiments, a targeting moiety comprising one or more GalNAc is conjugated (attached) to a CYP7A1 RNAi agent.

In some embodiments, the targeting moiety comprises a structure of Formula (I):

(I)

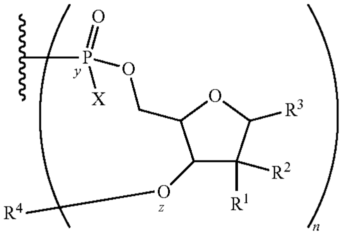

or a pharmaceutically acceptable salt thereof;

wherein:

each X is independently —N($R^A$)$_2$, —S$R^A$, or —O$R^A$;

each $R^1$ is independently hydrogen, halogen, substituted or unsubstituted aliphatic, substituted or unsubstituted heteroaliphatic, —O$R^A$, or a group of formula:

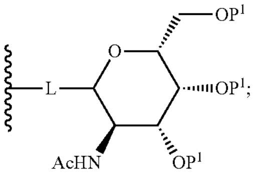

each $R^2$ is independently hydrogen, halogen, substituted or unsubstituted aliphatic, substituted or unsubstituted heteroaliphatic, —O$R^A$, or a group of formula:

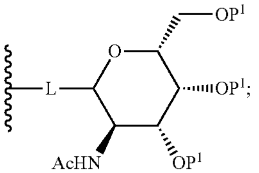

each $R^3$ is independently hydrogen, halogen, substituted or unsubstituted aliphatic, substituted or unsubstituted substituted or unsubstituted heteroalkyl, substituted or unsubstituted heteroalkenyl, substituted or unsubstituted heteroalkynyl, —O$R^A$, or a group of formula:

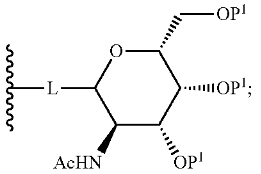

$R^4$ is hydrogen or substituted or unsubstituted alkyl;

each $P^1$ is independently hydrogen or an oxygen protecting group;

each L is independently a bond, substituted or unsubstituted aliphatic, substituted or unsubstituted substituted or unsubstituted heteroalkyl, substituted or unsubstituted heteroalkenyl, substituted or unsubstituted heteroalkynyl, substituted or unsubstituted carbocyclylene, substituted or unsubstituted arylene, —O—, —N($R^A$)—, —S—, —C(═O)—, —C(═O)O—, —C(═O)N$R^A$—, —N$R^A$C(═O)—, —N$R^A$C(═O)$R^A$—, —C(═O)$R^A$—, —N$R^A$C(═O)O—, —N$R^A$C(═O)N($R^A$)—, —OC(═O)—, —OC(═O)O—, —OC(═O)N($R^A$)—, —S(O)$_2$N$R^A$—, —N$R^A$S(O)$_2$—, or a combination thereof;

each $R^A$ is independently hydrogen, substituted or unsubstituted acyl, substituted or unsubstituted alkyl, substituted or unsubstituted alkenyl, substituted or unsubstituted alkynyl, substituted or unsubstituted heteroaliphatic, substituted or unsubstituted carbocyclyl, substituted or unsubstituted heterocyclyl, substituted or unsubstituted aryl, substituted or unsubstituted heteroaryl, a nitrogen protecting group when attached to a nitrogen atom, an oxygen protecting group when attached to an oxygen atom, or a sulfur protecting group when attached to a sulfur atom, or two $R^A$ groups are joined to form a substituted or unsubstituted heterocyclyl ring, or a substituted or unsubstituted heteroaryl ring; and n is 1-20;

wherein the phosphorous labeled y is conjugated to the 3' end of the sense strand; and wherein when n is greater than 1, with the exception of the phosphorous directly attached to an RNAi agent; each instance of phosphorous labeled y is bound to the oxygen labeled z of the adjacent repeat unit; provided that each repeat unit of Formula (I) in the targeting moiety comprises one group of formula:

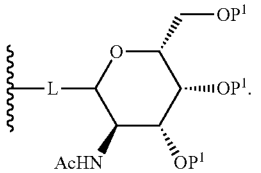

In some embodiments, the targeting moiety comprises a structure of Formula:

(I-a)

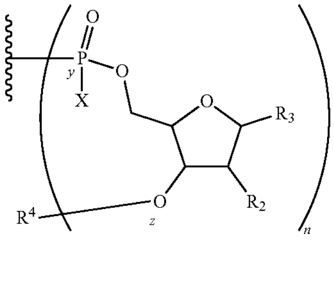

;

-continued
(I-a-1)
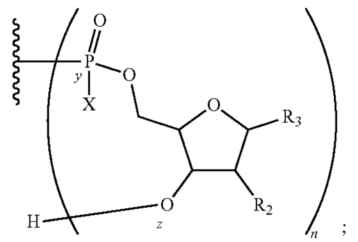
(I-b)
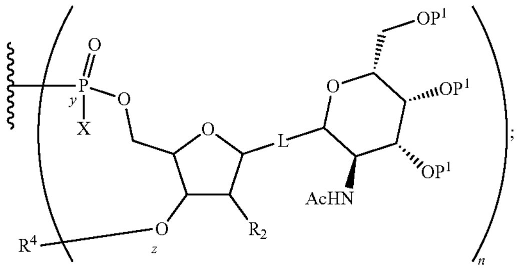
(I-b-1)
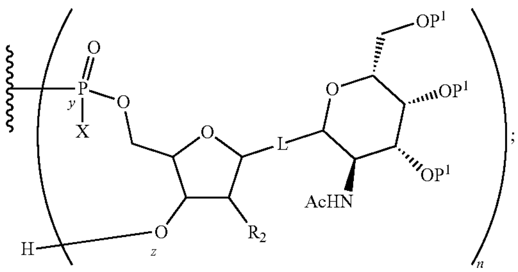
(I-c)
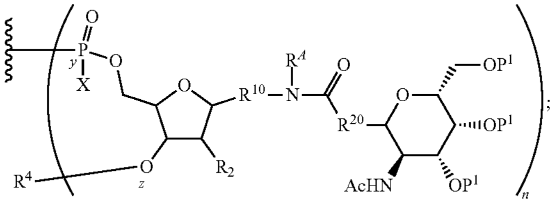
(I-c-1)
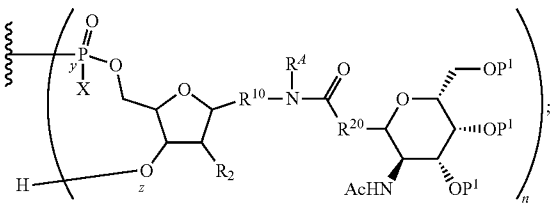
(I-d)
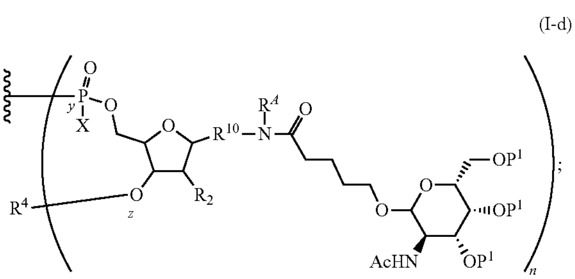
-continued
(I-d-1)
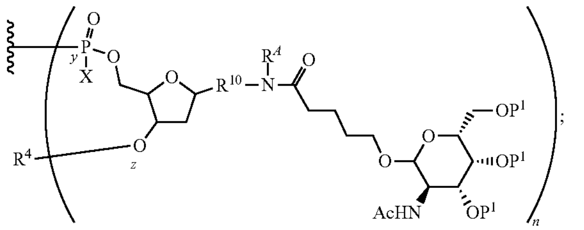
(I-e)
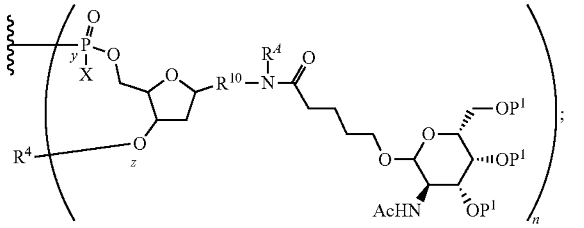
(I-e-1)
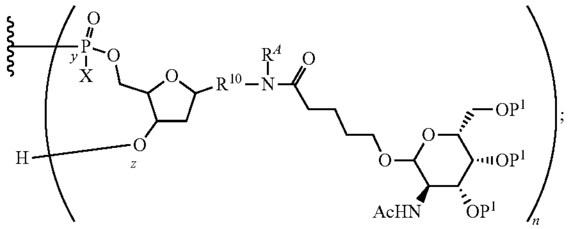
(I-f)
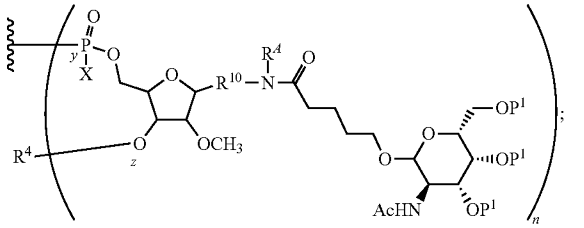
or
(I-f-1)
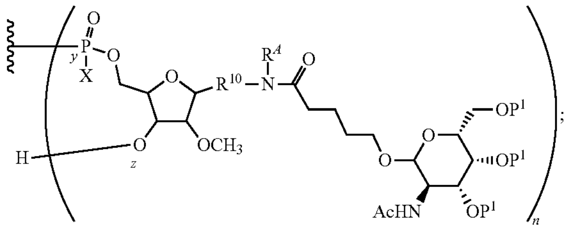
or a pharmaceutically acceptable salt thereof; wherein $R^{10}$ is substituted or unsubstituted $C_{1-8}$ alkylene having 0-3 carbon atoms replaced with —O—; and $R^{20}$ is substituted or unsubstituted $C_{1-8}$ alkylene having 0-3 carbon atoms replaced with —O—; and $P^1$, $R^2$, $R^1$, $R^4$, $R^A$, n, and X are as defined for Formula (I).

In some embodiments, the targeting moiety comprises a structure of formula:
(I-g)
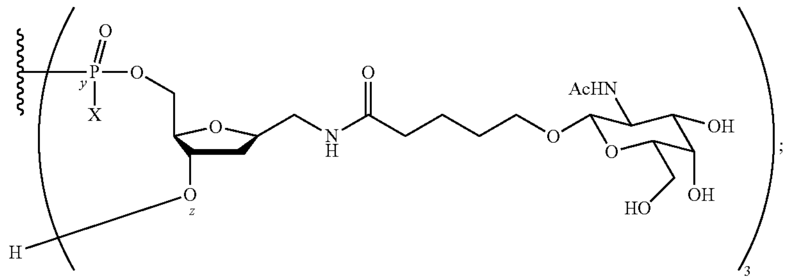
;
(I-h)
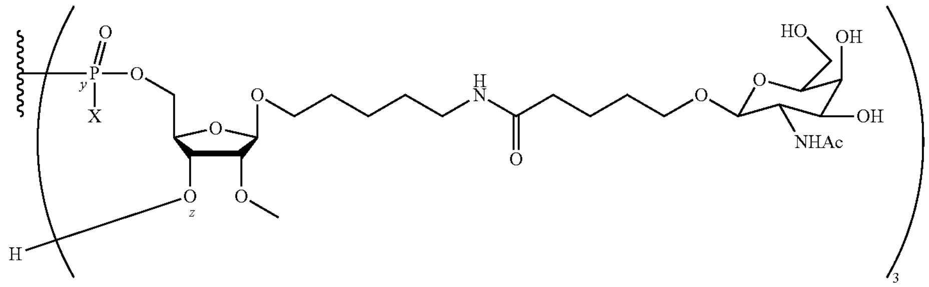
;
(I-i)
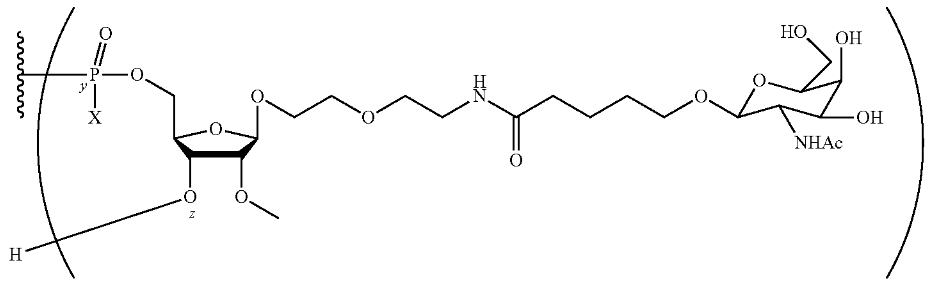
; or
(I-j)
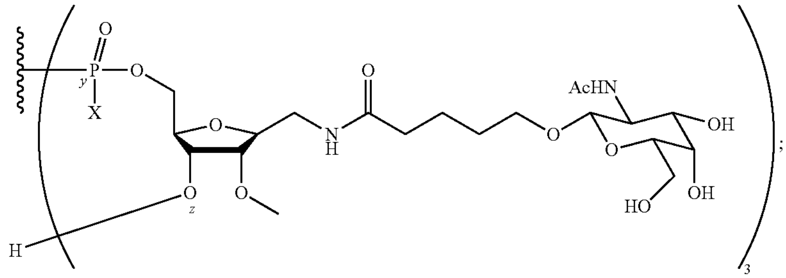
;
or a pharmaceutically acceptable salt thereof, wherein X is as defined for Formula (I).
In some embodiments, the targeting moiety does not comprise a structure of:
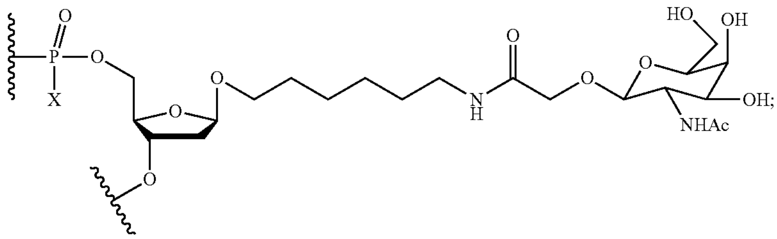
; or -continued

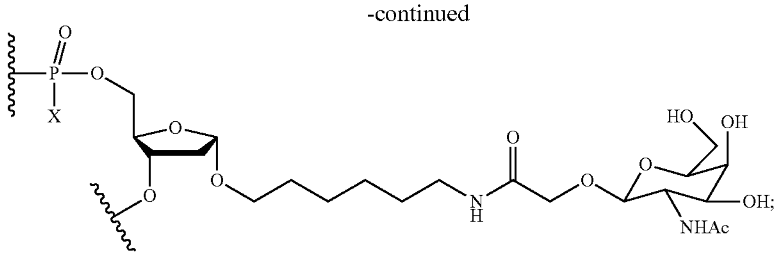

or a salt thereof, wherein X is —$OR^A$ or —$SR^A$ (e.g., where $R^A$ is H).

In some embodiments, the targeting moiety does not comprise a structure of:

L does not attach to the 1' position of the ribose by a nitrogen atom.

In some embodiments, the targeting moiety does not comprise a structure of formula:

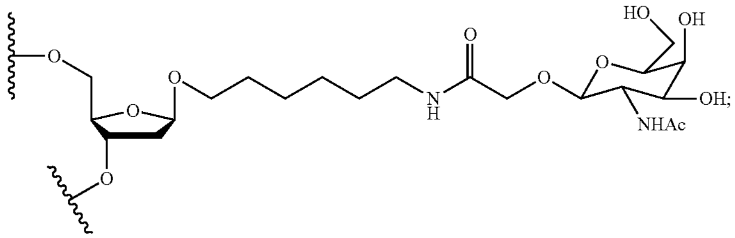

or

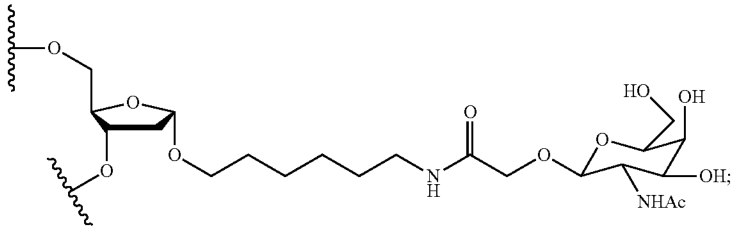

or a salt thereof.

In some embodiments, in a targeting moiety comprising a structure of Formula (I), when $R^1$ and $R^2$ are hydrogen, and $R^3$ is a group of formula

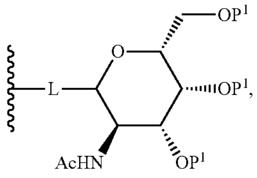

L does not attach to the 1' position of the ribose by an oxygen atom.

In some embodiments, in a targeting moiety comprising a structure of Formula (I), when $R^3$ is a group of formula

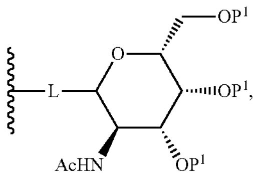

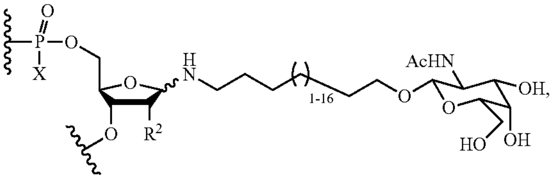

or a salt thereof, wherein X is —$OR^A$ or —$SR^A$ (e.g., where $R^A$ is H); and $R^2$ is hydrogen, halogen, substituted or unsubstituted aliphatic, substituted or unsubstituted heteroaliphatic, or —$OR^A$. In some embodiments, the targeting moiety does not comprise a group of the above formula, wherein X is —$OR^A$ or —$SR^A$ (e.g., where $R^A$ is H); and $R^2$ is hydrogen, fluoro, —$OCH_3$, —OTBS, or —$OCH_2CH_2OCH_3$.

In some embodiments, the targeting moiety does not comprise a structure of formula:

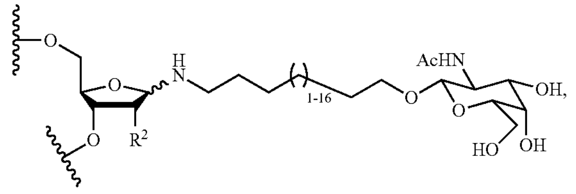

or a salt thereof, wherein $R^2$ is hydrogen, halogen, substituted or unsubstituted aliphatic, substituted or unsubstituted heteroaliphatic, or $—OR^A$. In some embodiments, the targeting moiety does not comprise a group of the above formula, wherein $R^2$ is hydrogen, fluoro, $—OCH_3$, —OTBS, or $—OCH_2CH_2OCH_3$.

In some embodiments, the targeting moiety does not comprise a group of formula:

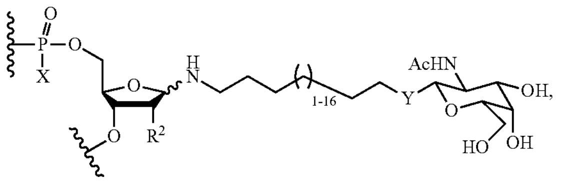

or a salt thereof, wherein X is $—OR^A$ or $—SR^A$ (e.g., where $R^A$ is H); Y is —O—, —S—, $—CH_2—$, —NH(C=O)—, —(C=O)NH—, or —NH(C=O)O—; and $R^2$ is hydrogen, halogen, substituted or unsubstituted aliphatic, substituted or unsubstituted heteroaliphatic, or $—OR^A$. In some embodiments, the targeting moiety does not comprise a group of the above formula, wherein X is $—OR^A$ or $—SR^A$ (e.g., where $R^A$ is H); Y is —O—, —S—, $—CH_2—$, —NH(C=O)—, —(C=O)NH—, or —NH(C=O)O—; and $R^2$ is hydrogen, fluoro, $—OCH_3$, —OTBS, or $—OCH_2CH_2OCH_3$.

In some embodiments, the targeting moiety does not comprise a structure of formula:

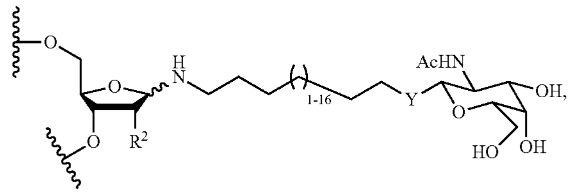

or a salt thereof, wherein Y is —O—, —S—, $—CH_2—$, —NH(C=O)—, —(C=O)NH—, or —NH(C=O)O—; and $R^2$ is hydrogen, halogen, substituted or unsubstituted aliphatic, substituted or unsubstituted heteroaliphatic, or $—OR^A$. In some embodiments, the targeting moiety does not comprise a group of the above formula, wherein Y is —O—, —S—, $—CH_2—$, —NH(C=O)—, —(C=O)NH—, or —NH(C=O)O—; and $R^2$ is hydrogen, fluoro, $—OCH_3$, —OTBS, or $—OCH_2CH_2OCH_3$.

In some embodiments, the targeting moiety comprises a structure of Formula (II):

(II)

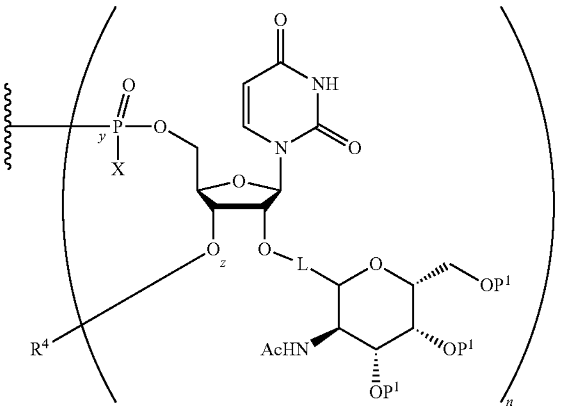

or a pharmaceutically acceptable salt thereof;

wherein:

$R^4$ is hydrogen or substituted or unsubstituted alkyl;

each X is independently $—N(R^A)_2$, $—SR^A$, or $—OR^A$;

each $P^1$ is independently hydrogen or an oxygen protecting group;

each L is independently a bond, substituted or unsubstituted aliphatic, substituted or unsubstituted heteroaliphatic, substituted or unsubstituted carbocyclylene, substituted or unsubstituted heterocyclylene, substituted or unsubstituted arylene, —O—; $—N(R^A)—$, —S—, —C(=O)—, —C(=O)O—, $—C(=O)NR^A—$, $—NR^AC(=O)—$, $—NR^AC(=O)R^A—$, $—C(=O)R^A—$, $—NR^AC(=O)O—$, $—NR^AC(=O)N(R^A)—$, —OC(=O)—, —OC(=O)O—, $—OC(=O)N(R^A)—$, $—S(O)_2NR^A—$, $—NR^AS(O)_2—$, or a combination thereof;

each $R^A$ is independently hydrogen, substituted or unsubstituted acyl, substituted or unsubstituted alkyl, substituted or unsubstituted alkenyl, substituted or unsubstituted alkynyl, substituted or unsubstituted heteroaliphatic, substituted or unsubstituted carbocyclyl, substituted or unsubstituted heterocyclyl, substituted or unsubstituted aryl, substituted or unsubstituted heteroaryl, a nitrogen protecting group when attached to a nitrogen atom, an oxygen protecting group when attached to an oxygen atom, or a sulfur protecting group when attached to a sulfur atom, or two $R^A$ groups are joined to form a substituted or unsubstituted heterocyclyl ring, or a substituted or unsubstituted heteroaryl ring; and n is 1-20;

wherein the phosphorous labeled y is conjugated to the 3' end of the sense strand; and wherein when n is greater than 1, with the exception of the phosphorous directly attached to the RNAi agent, each instance of phosphorous labeled y is bound to the oxygen labeled z of the adjacent repeat unit.

In some embodiments, the targeting moiety comprises a structure of Formula:

(II-a)

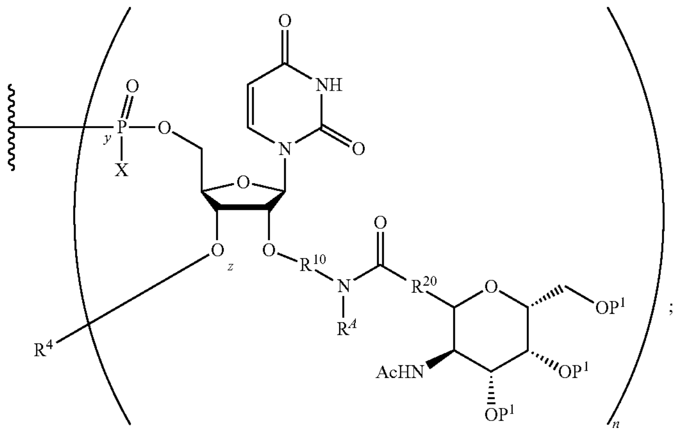

; or (II-b)

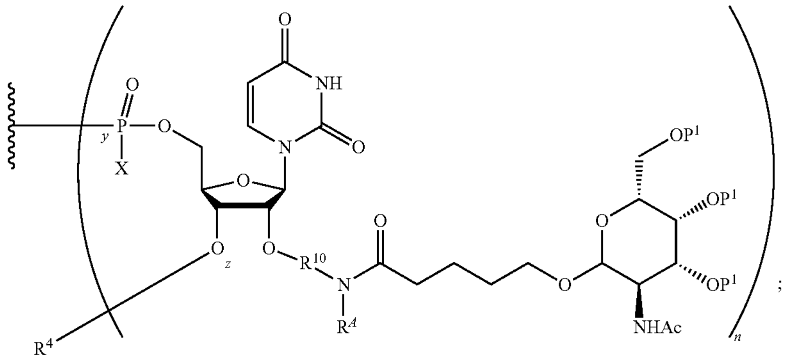

;

or a pharmaceutically acceptable salt thereof; wherein $R^{10}$ is substituted or unsubstituted $C_{1-8}$ alkylene having 0-3 carbon atoms replaced with —O—; and $R^{20}$ is substituted or unsubstituted $C_{1-8}$ alkylene having 0-3 carbon atoms replaced with —O—; and $P^1$, $R^4$, $R^A$, n, and X are as defined for Formula (II).

In some embodiments, the targeting moiety comprises a structure of formula:

(II-c)

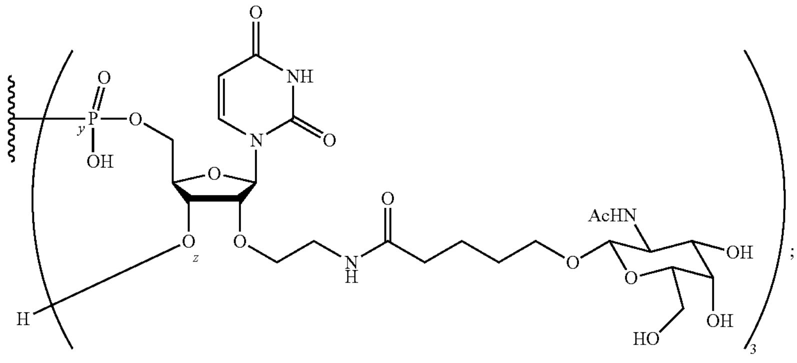

;

or a pharmaceutically acceptable salt thereof, wherein X is as defined for Formula (II).

In some embodiments, the targeting moiety comprises a structure of Formula (III):

(III)

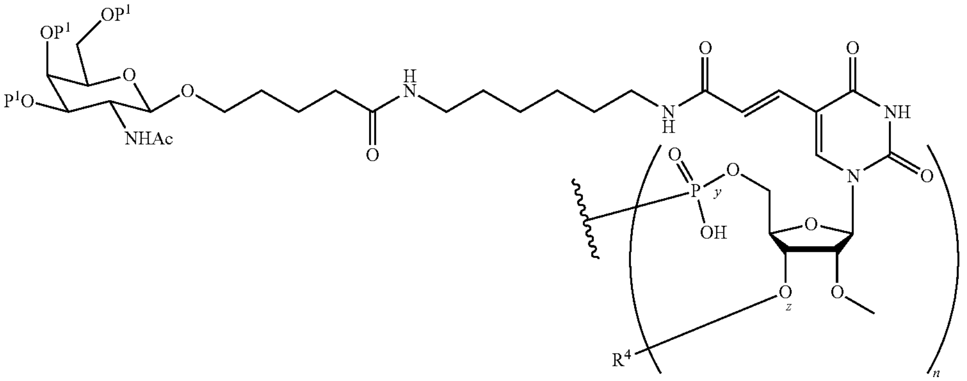

or a pharmaceutically acceptable salt thereof,
wherein:

$R^4$ is hydrogen or substituted or unsubstituted alkyl;

each X is independently —$N(R^A)_2$, —$SR^A$, or —$OR^A$;

each $P^1$ is independently hydrogen or an oxygen protecting group;

each $R^A$ is independently hydrogen, substituted or unsubstituted acyl, substituted or unsubstituted alkyl, substituted or unsubstituted alkenyl, substituted or unsubstituted alkynyl, substituted or unsubstituted heteroaliphatic, substituted or unsubstituted carbocyclyl, substituted or unsubstituted heterocyclyl, substituted or unsubstituted aryl, substituted or unsubstituted heteroaryl, an oxygen protecting group when attached to an oxygen atom, or a sulfur protecting group when attached to a sulfur atom; and n is 1-20;

wherein the phosphorous labeled y is conjugated to the 3' end of the sense strand; and wherein when n is greater than 1, with the exception of the phosphorous directly attached to the RNAi agent, each instance of phosphorous labeled y is bound to the oxygen labeled z of the adjacent repeat unit.

In some embodiments, the targeting moiety comprises a structure of formula:

(III-a)

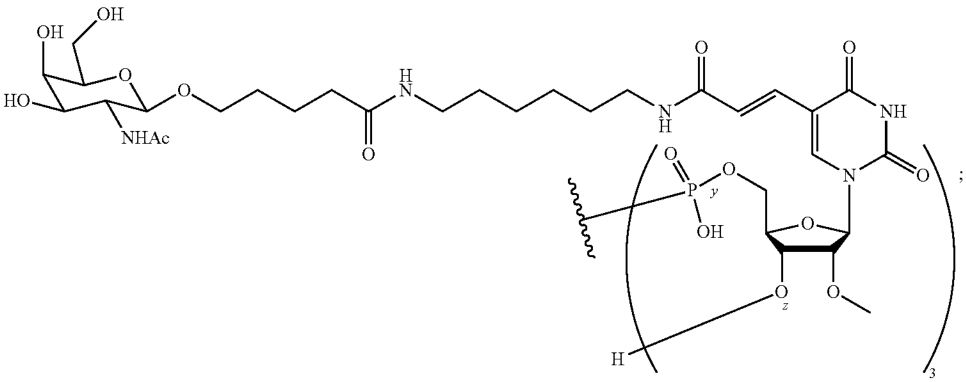

;

or a pharmaceutically acceptable salt thereof, wherein X is as defined for Formula (III).

In some embodiments, the targeting moiety comprises a structure of Formula (IV):

(IV)

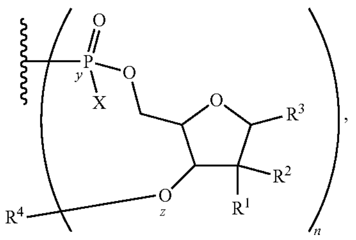

wherein:

each X is independently —N($R^A$)$_2$, —S$R^A$, or —O$R^A$;

each $R^1$ is independently hydrogen, halogen, substituted or unsubstituted aliphatic, substituted or unsubstituted heteroaliphatic, or —O$R^A$;

each $R^2$ is independently hydrogen, halogen, substituted or unsubstituted aliphatic, substituted or unsubstituted heteroaliphatic, or —O$R^A$;

each $R^3$ is independently of formula:

$R^4$ is hydrogen or substituted or unsubstituted alkyl;

each $P^1$ is independently hydrogen or an oxygen protecting group;

each L is independently a bond, substituted or unsubstituted aliphatic, substituted or unsubstituted heteroalkyl, substituted or unsubstituted heteroalkenyl, substituted or unsubstituted heteroalkynyl, substituted or unsubstituted carbocyclylene, substituted or unsubstituted arylene, —O—, —N($R^A$)—, —S—, —C(═O)—, —C(═O)O—, —C(═O)N$R^A$—, —N$R^A$C(═O)—, —N$R^A$C(═O)$R^A$—, —C(═O)$R^A$—, —N$R^A$C(═O)O—, —N$R^A$C(═O)N($R^A$)—, —OC(═O)—, —OC(═O)O—, —OC(═O)N($R^A$)—, —S(O)$_2$N$R^A$—, —N$R^A$S(O)$_2$—, or a combination thereof;

each $R^A$ is independently hydrogen, substituted or unsubstituted acyl, substituted or unsubstituted alkyl, substituted or unsubstituted alkenyl, substituted or unsubstituted alkynyl, substituted or unsubstituted heteroaliphatic, substituted or unsubstituted carbocyclyl, substituted or unsubstituted heterocyclyl, substituted or unsubstituted aryl, substituted or unsubstituted heteroaryl, a nitrogen protecting group when attached to a nitrogen atom, an oxygen protecting group when attached to an oxygen atom, or a sulfur protecting group when attached to a sulfur atom, or two $R^A$ groups

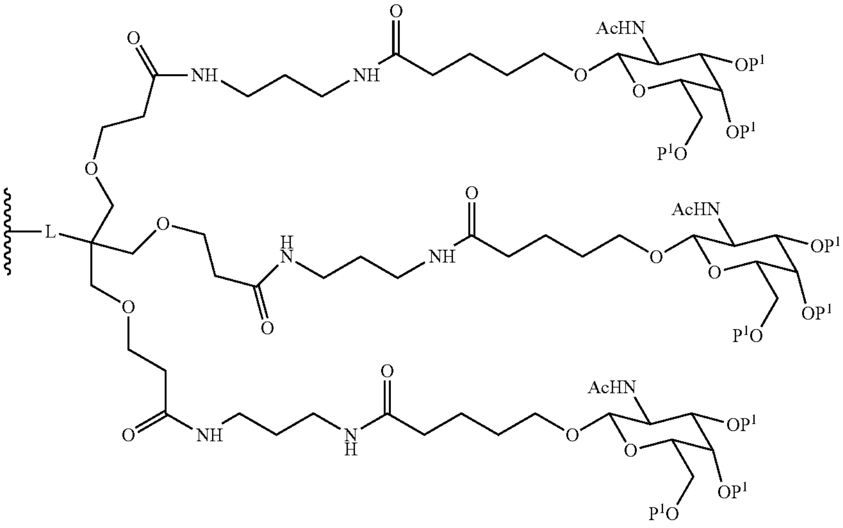

or

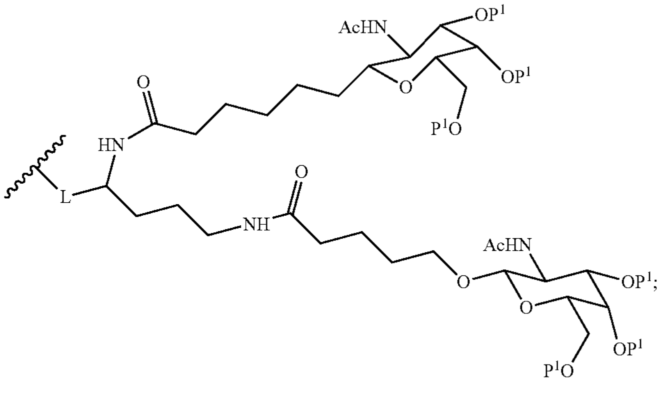

are joined to form a substituted or unsubstituted heterocyclyl ring, or a substituted or unsubstituted heteroaryl ring; and n is 1-20;

wherein the phosphorous labeled y is conjugated to the 3' end of the sense strand; and wherein when n is greater than 1, with the exception of the phosphorous directly attached to the RNAi agent, each instance of phosphorous labeled y is bound to the oxygen labeled z of the adjacent repeat unit.

In some embodiments, the targeting moiety comprises a structure of formula:

(IV-a)

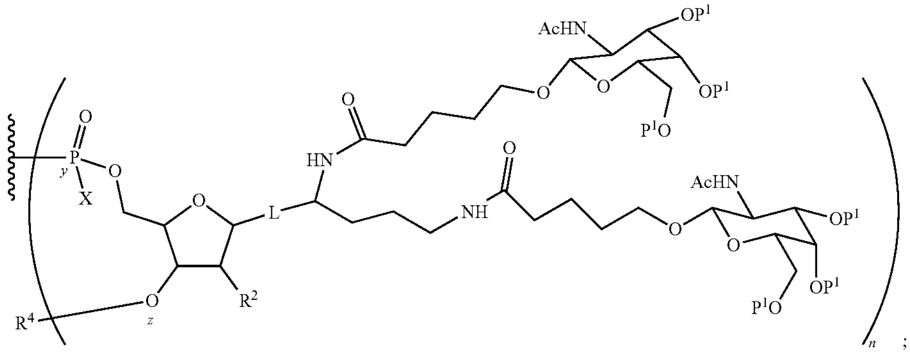

;

(IV-b)

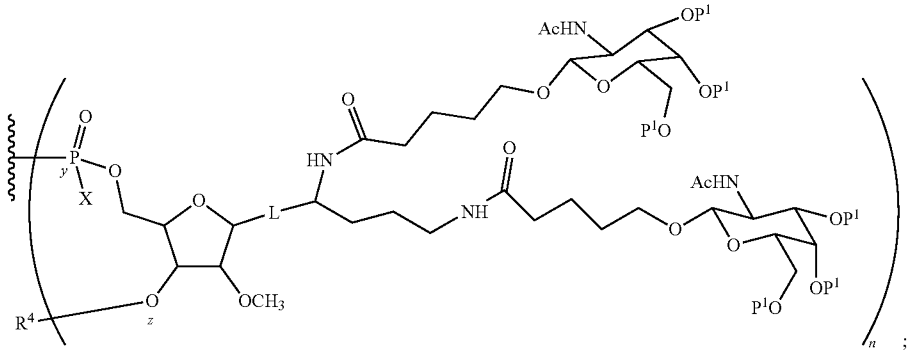

;

(IV-c)

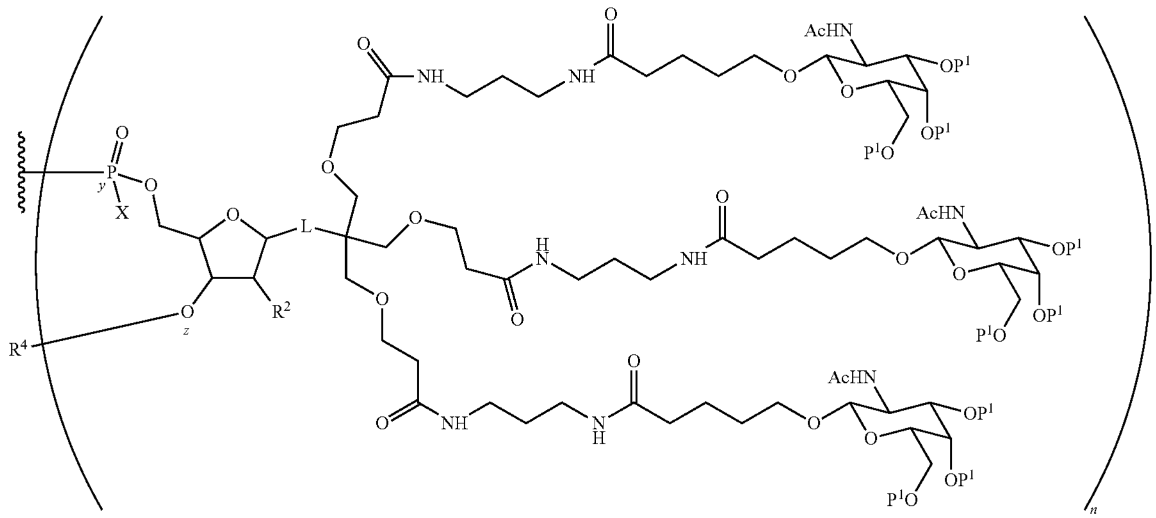

; or

-continued (IV-d)

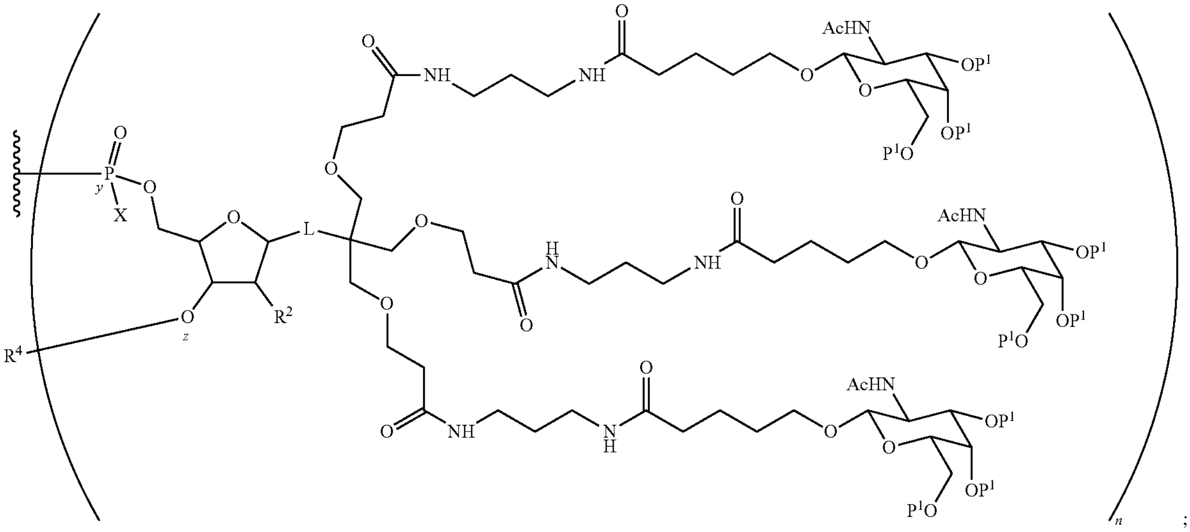

or a pharmaceutically acceptable salt thereof; wherein $R^4$, L, $P^1$, n, and X are as defined for Formula (IV). For any one of Formulas (IV-a), (IV-b), (IV-c), and (IV-d), when n is greater than 1, with the exception of the phosphorous directly attached to the RNAi agent, each instance of phosphorous labeled y is bound to the oxygen labeled z of the adjacent repeat unit, and with the exception of the oxygen directly attached to $R^4$, each instance of oxygen labeled z is bound to the phosphorous labeled y of the adjacent unit.

In some embodiments, the targeting moiety comprises a structure of formula:

(IV-e)

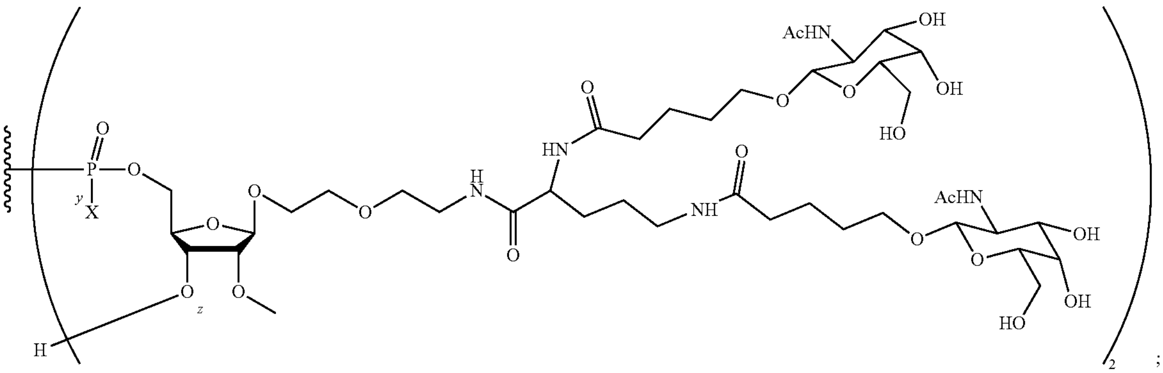

; or (IV-f)

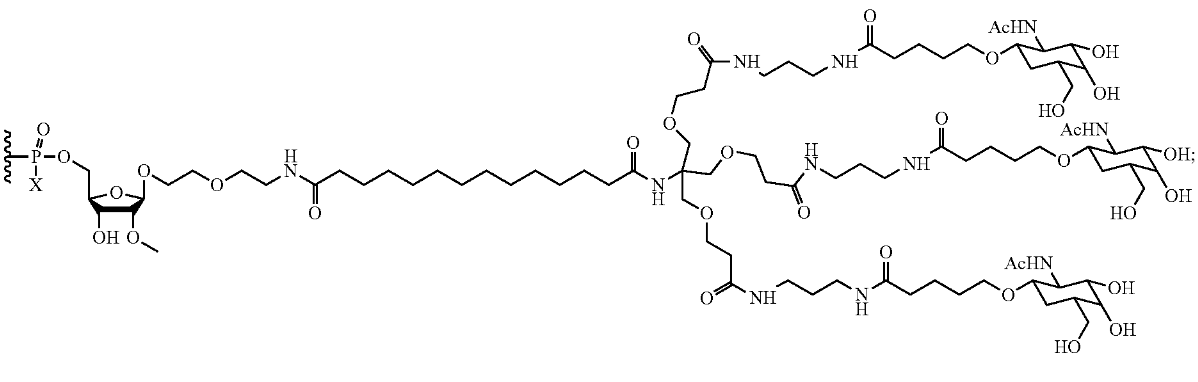

or a pharmaceutically acceptable salt thereof, wherein X is as defined for Formula (IV). For Formula (IV-e), with the exception of the phosphorous directly attached to the RNAi agent, each instance of phosphorous labeled y is bound to the oxygen labeled z of the adjacent repeat unit, and with the exception of the oxygen directly attached to hydrogen, the oxygen labeled z is bound to the phosphorous labeled y of the adjacent unit.

In some embodiments, in a targeting moiety comprising a structure of Formula (I), (II), (III), or (IV), n is 1-6. In some embodiments, in a targeting moiety comprising a structure of Formula ((I), (II), (III), or (IV), n is 1-3. In some embodiments, in a targeting moiety comprising a structure of Formula (I), (II), (III), or (IV), n is 2-3. In some embodiments, in a targeting moiety comprising a structure of Formula (I), (II), (III), or (IV), n is 1-4. In some embodiments, in a targeting moiety comprising a structure of Formula (I), (II), (III), or (IV), n is 2-4. In some embodiments, in a targeting moiety comprising a structure of Formula (I), (II), (III), or (IV), n is 1. In some embodiments, in a targeting moiety comprising a structure of Formula (I), (II), (I), or (IV), n is 2. In some embodiments, in a targeting moiety comprising a structure of Formula (I), (II), (III), or (IV), n is 3. In some embodiments, the targeting moiety is conjugated to the sense strand via the phosphorous labeled y. In some embodiments, the targeting moiety is conjugated to the 3' end of the sense strand via the phosphorous labeled y.

In some embodiments, in a targeting moiety comprising a structure of Formula (I), (II), (III), or (IV), each X is independently —$SR^A$. In some embodiments, in a targeting moiety comprising a structure of Formula (I), (II), (III), or (IV), each X is independently —$OR^A$. In some embodiments, in a targeting moiety comprising a structure of Formula (I), (II), (III), or (IV), each X is independently —SH or —OH. In some embodiments, in a targeting moiety comprising a structure of Formula (I), (II), (III), or (IV), each X is independently —SH. In some embodiments, in a targeting moiety comprising a structure of Formula (I), (II), (III), or (IV), each X is independently —OH.

Table 4 lists various exemplary GalNAc targeting moieties. Included are pharmaceutically acceptable salts of the exemplary targeting moieties.

TABLE 4

| Exemplary targeting moieties comprising GalNAc | |
|---|---|
| Targeting Moiety ID: | Structure |
| ($Z^1$) | 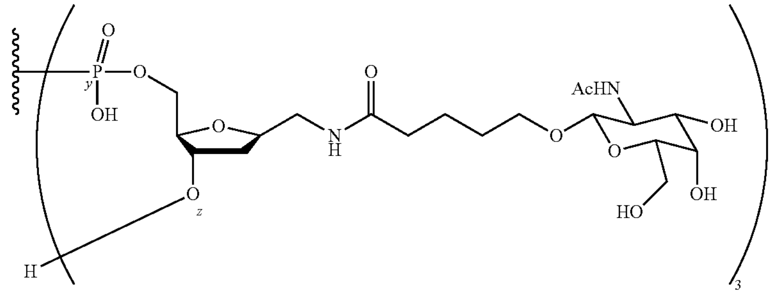 |
| ($Z^2$) | 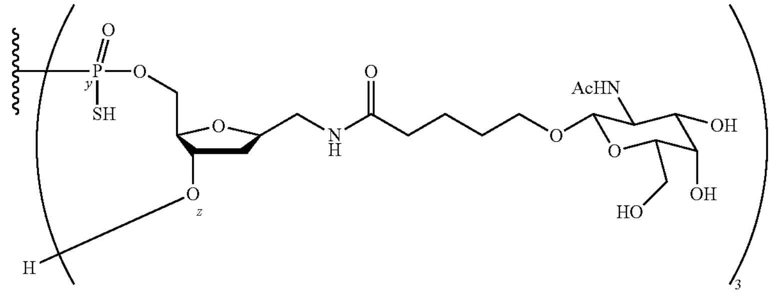 |
| ($Z^3$) | 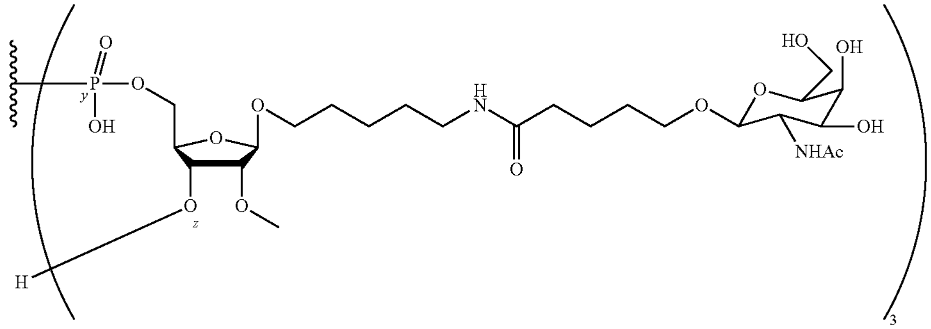 |

TABLE 4-continued
| Exemplary targeting moieties comprising GalNAc | |
|---|---|
| Targeting Moiety ID: | Structure |
| (Z[4]) | 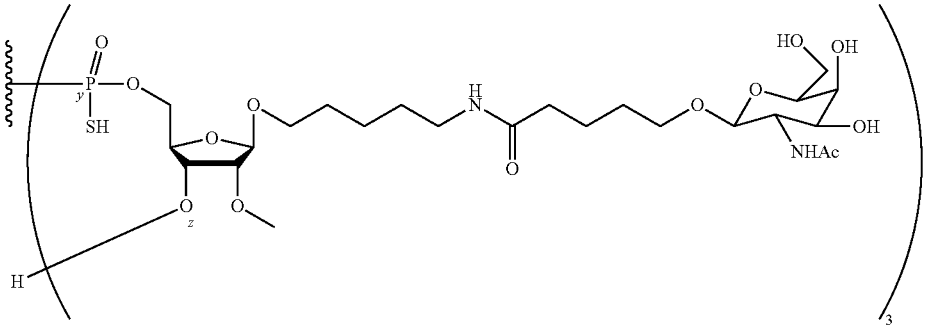 |
| (Z[5]) | 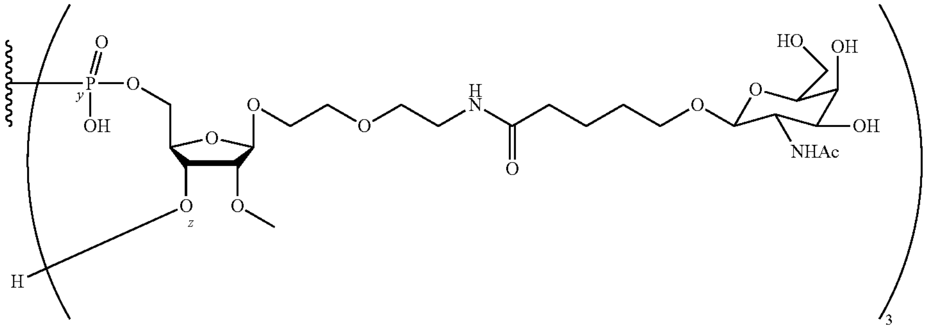 |
| (Z[6]) | 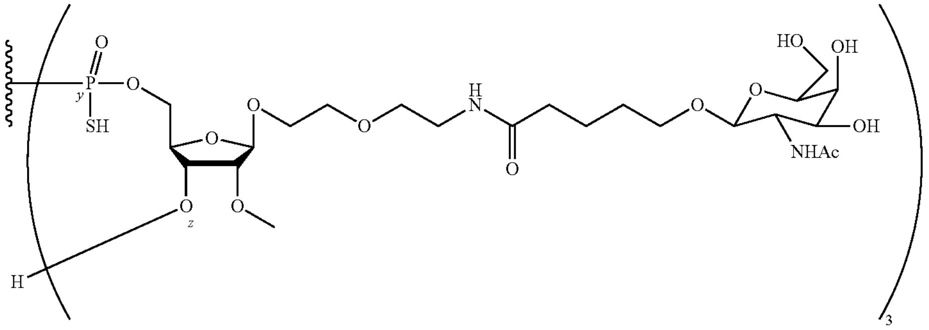 |
| (Z[7]) | 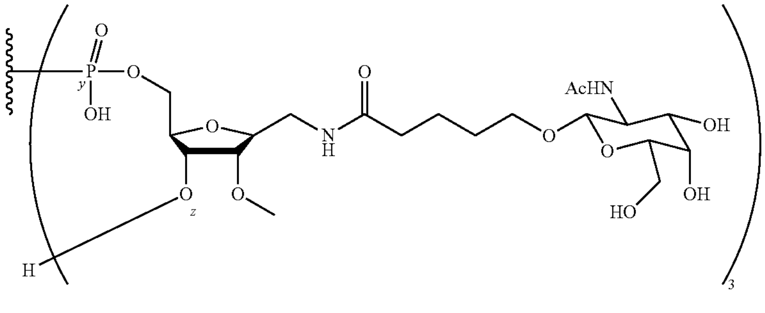 |

TABLE 4-continued
| Exemplary targeting moieties comprising GalNAc | |
|---|---|
| Targeting Moiety ID: | Structure |
| ($Z^8$) | 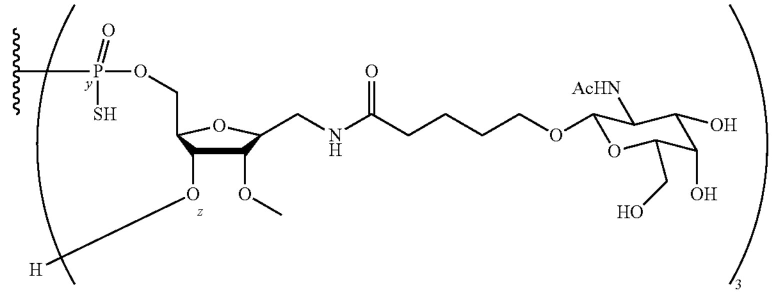 |
| ($Z^9$) | 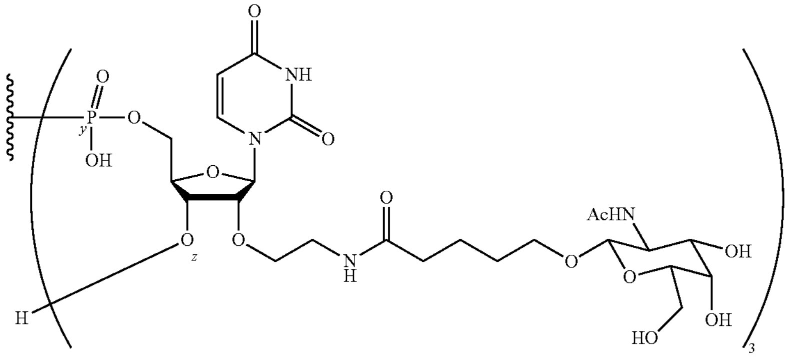 |
| ($Z^{10}$) | 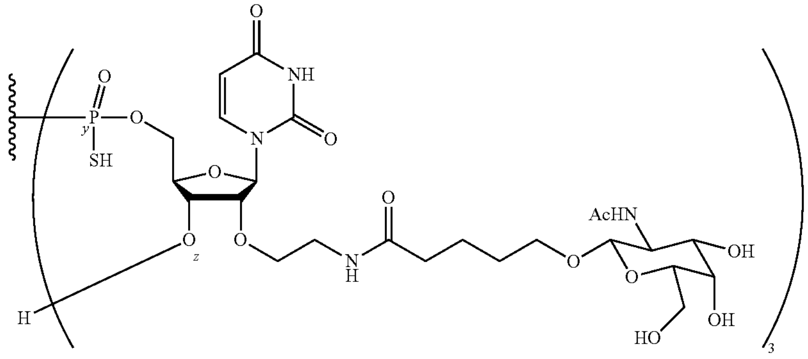 |
| ($Z^{11}$) | 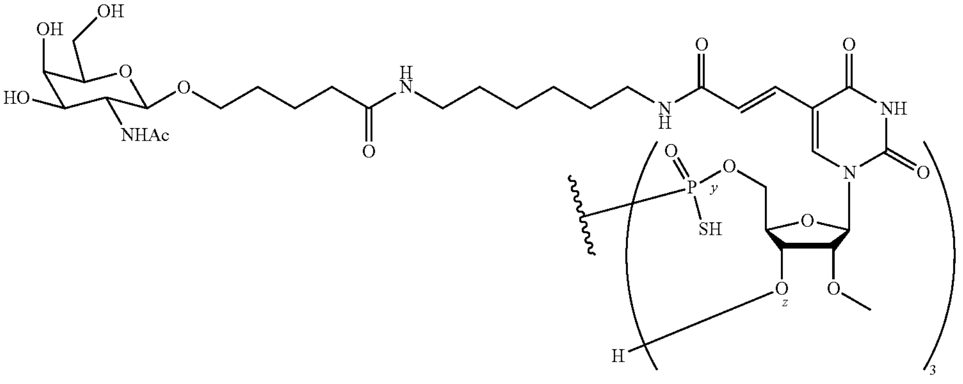 |

TABLE 4-continued
| Exemplary targeting moieties comprising GalNAc | |
|---|---|
| Targeting Moiety ID: | Structure |
| ($Z^{12}$) | 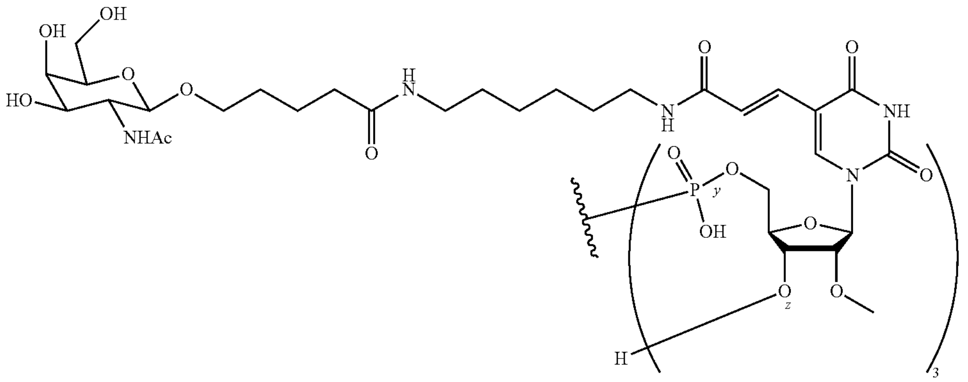 |
| ($Z^{13}$) | 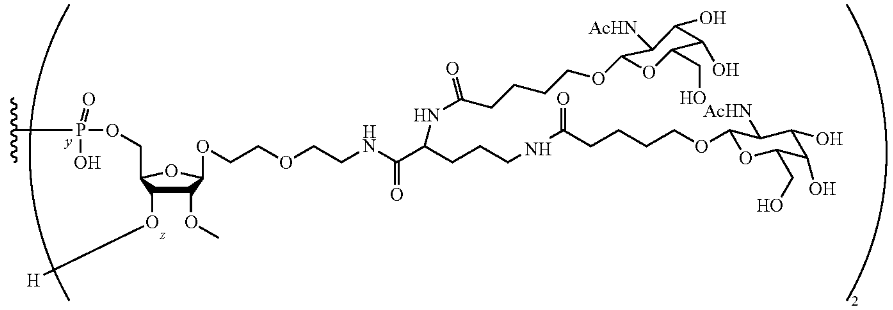 |
| ($Z^{14}$) | 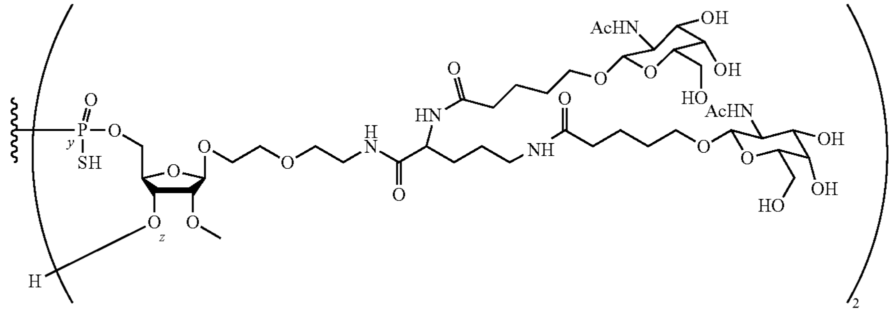 |
| ($Z^{15}$) | 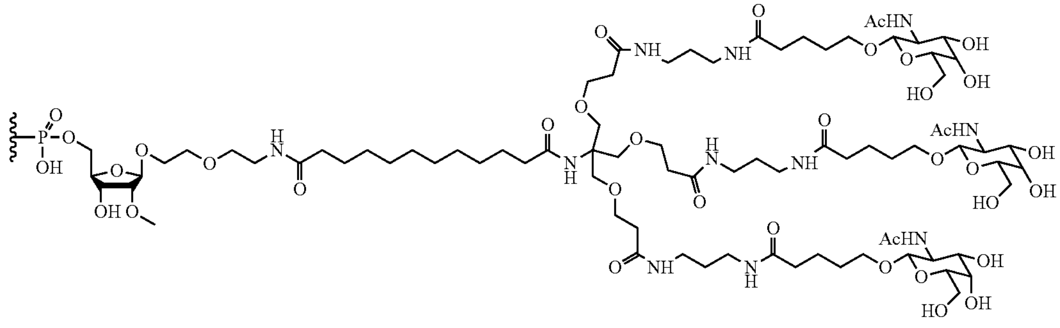 |

TABLE 4-continued

| Exemplary targeting moieties comprising GalNAc | |
|---|---|
| Targeting Moiety ID: | Structure |
| ($Z^{16}$) | 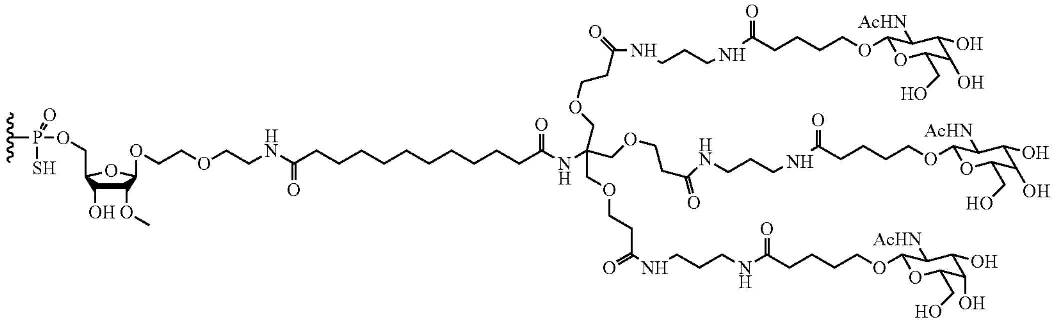 |

For any one of Formulas ($Z^1$)-($Z^{16}$), with the exception of the phosphorous directly attached to the RNAi agent, each instance of phosphorous labeled y is bound to the oxygen labeled z of the adjacent repeat unit, and with the exception of the oxygen directly attached to hydrogen, each instance of oxygen labeled z is bound to the phosphorous labeled y of the adjacent unit.

In some embodiments, a targeting moiety is linked to the RNAi agent via a linker. Various linkers may be used to conjugate a targeting moiety to any one of the RNAi agents described herein. The linker facilitates covalent linkage of the agent to a targeting moiety. The linker is conjugated to the 5' or 3' end of an RNAi agent sense strand or antisense strand. In some embodiments, the linker is conjugated to the 5' or 3' end of an RNAi agent sense strand. In some embodiments, a linker is conjugated to the 5' end of an RNAi agent sense strand. In some embodiments, a linker is conjugated to the 3' end of an RNAi agent sense strand. In some embodiments, a linker is conjugated to the 5' end of an RNAi agent antisense strand. In some embodiments, a linker is conjugated to the 3' end of an RNAi agent antisense strand. Examples of linkers can include, but are not limited to: reactive groups such a primary amines and alkynes, alkyl groups, abasic nucleotides, ribitol (abasic ribose), non-nucleotidic linker, and/or PEG groups. In some embodiments, the linker is a monovalent, bivalent, trivalent, or tetravalent branched linker. In some embodiments, the linker is a phosphorus-containing linker (e.g., phosphate, phosphodiester, phosphorothioate, phosphorodithioate, phosphoroamidate, etc), or other linker. Non-limiting examples of other linkers can include, but are not limited to: reactive groups such a primary amines and alkynes, alkyl groups, abasic nucleotides, ribitol (abasic ribose), and/or PEG groups. In some embodiments, the linker is a phosphorothioate linkage.

In some embodiments, any one of the CYP7A1 RNAi agents described herein is conjugated (e.g., covalently linked) linked to a targeting moiety comprising a structure of any one of Formulae ($Z^1$)-($Z^{16}$). For any one of Formulas ($Z^1$)-($Z^{16}$) referred to herein, with the exception of the phosphorous directly attached to the RNAi agent, each instance of phosphorous labeled y is bound to the oxygen labeled z of the adjacent repeat unit, and with the exception of the oxygen directly attached to hydrogen, each instance of oxygen labeled z is bound to the phosphorous labeled y of the adjacent unit. In some embodiments, any one of the CYP7A1 RNAi agents described herein is (e.g., covalently linked) to a targeting moiety comprising a structure of Formula ($Z^6$). In some embodiments, any one of the CYP7A1 RNAi agents described herein is (e.g., covalently linked) at the 3' end (e.g., to the 3' terminal nucleoside) of the sense strand to a targeting moiety comprising a structure of Formula ($Z^6$). For any one of Formula ($Z^6$) referred to herein, with the exception of the phosphorous directly attached to the sense strand, each instance of phosphorous labeled y is bound to the oxygen labeled z of the adjacent repeat unit, and with the exception of the oxygen directly attached to hydrogen, each instance of oxygen labeled z is bound to the phosphorous labeled y of the adjacent unit.

Unless stated otherwise, use of the symbol

means that any group or groups may be linked thereto that is in accordance with the scope of the inventions described herein. For example, in any one of the structures of Formulae: (I), (I-a), (I-a-1), (I-b), (I-b-1), (I-c), (I-c-1), (I-d), (I-d-1), (I-e), (I-e-1), (I-f), (I-f-1), (I-g), (I-h), (I-i), (I-j), (II), (II-a), (II-b), (II-c), (III), (III-a), (IV), (IV-a), (IV-b), (IV-c), (IV-d), (IV-e), (IV-f), and ($Z^1$)-($Z^{16}$), the symbol

means the attachment point at which the RNAi agent (e.g., at the 3'-O of the sugar moiety of the 3' terminal nucleoside of the sense strand) is attached to the target moiety.

It is to be understood that in an RNAi agent (e.g., CYP7A1 RNAi agent) that further comprises a targeting moiety conjugated to the 3' terminal nucleoside of the sense strand, the 3'-terminal nucleoside is linked to the targeting moiety via a phosphorothioate linkage. As such, when the 3'-terminal nucleoside of the sense strand is represented as [mAs] (e.g., the sense strands of the siRNAs provided in Table 9 and elsewhere in the present disclosure), the "s" corresponds to the phosphorothioate linkage (e.g.,

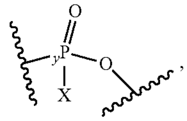

wherein X is —SH, i.e.,

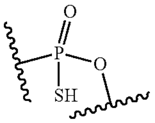

)

of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formulae: (I), (I-a), (I-a-1), (I-b), (I-b-1), (I-c), (I-c-1), (I-d), (I-d-1), (I-e), (I-e-1), (I-f), (I-f-1), (I-g), (I-h), (I-i), (I-j), (II), (II-a), (II-b), (II-c), (III), (III-a), (IV), (IV-a), (IV-b), (IV-c), (IV-d), (IV-e), (IV-f), or ($Z^1$)-($Z^{16}$).

Examples of RNAi Agents Conjugated to Targeting Moieties

Aspects of the present disclosure provide conjugates comprising any one of the RNAi agents described herein conjugated to any one of the targeting moieties described herein (e.g., comprising one or more GalNAc, such as targeting moieties comprising a structure of Formula (I), (I-a), (I-a-1), (I-b), (I-b-1), (I-c), (I-c-1), (I-d), (I-d-1), (I-e), (I-e-1), (I-f), (I-f-1), (I-g), (I-h), (I-i), (I-J), (II), (II-a), (II-b), (II-c), (III), (III-a), (IV), (IV-a), (IV-b), (IV-c), (IV-d), (IV-e), (IV-f), or ($Z^1$)-($Z^{16}$)). In some embodiments, an RNAi agent (e.g., CYP7A1 RNAi agent) is conjugated to a targeting moiety (e.g., comprising one or more GalNAc, such as targeting moieties of Formula (I), (I-a), (I-a-1), (I-b), (I-b-1), (I-c), (I-c-1), (I-d), (I-d-1), (I-e), (I-e-1), (I-f), (I-f-1), (I-g), (I-h), (I-i), (I-j), (II), (II-a), (II-b), (II-c), (III), (III-a), (IV), (IV-a), (IV-b), (IV-c), (IV-d), (IV-e), (IV-f), or ($Z^1$)-($Z^{16}$)) via a linker described herein. In some embodiments, an RNAi agent (e.g., CYP7A1 RNAi agent) is conjugated to a targeting moiety via a monovalent, bivalent, trivalent, or tetravalent branched linker. In some embodiments, an RNAi agent (e.g., CYP7A1 RNAi agent) is conjugated to a targeting moiety via a phosphorus-containing linker (e.g., a phosphorothioate linkage).

In some embodiments, a CYP7A1 RNAi agent described herein is conjugated (e.g., covalently linked) to any one of the targeting moieties described herein (e.g., comprising one or more GalNAc, such as targeting moieties of Formula (I), (I-a), (I-a-1), (I-b), (I-b-1), (I-c), (I-c-1), (I-d), (I-d-1), (I-e), (I-e-1), (I-f), (I-f-1), (I-g), (I-h), (I-i), (I-j), (II), (II-a), (II-b), (II-c), (III), (III-a), (IV), (IV-a), (IV-b), (IV-c), (IV-d), (IV-e), (IV-f), or ($Z^1$)-($Z^{16}$)) via a linker (e.g., a phosphorothioate linkage), wherein the CYP7A1 RNAi agent comprises a sense strand and an antisense strand forming a duplex region, wherein the antisense strand comprises a region of complementarity comprising a region of complementarity of at least 15 nucleosides to a target sequence in CYP7A1 mRNA, (e.g., a target sequence listed in Table 2), wherein the region of complementarity comprises a nucleoside sequence that contains no more than 3 mismatches to the CYP7A1 target sequence, and wherein the sense strand is at least substantially complementary to the antisense strand.

In some embodiments, a CYP7A1 RNAi agent described herein is conjugated (e.g., covalently linked) to any of the targeting moieties described herein (e.g., comprising one or more GalNAc, such as targeting moieties of Formula (I), (I-a), (I-a-1), (I-b), (I-b-1), (I-c), (I-c-1), (I-d), (I-d-1), (I-e), (I-e-1), (I-f), (I-f-1), (I-g), (I-h), (I-i), (I-j), (II), (II-a), (II-b), (II-c), (III), (III-a), (IV), (IV-a), (IV-b), (IV-c), (IV-d), (IV-e), (IV-f), or ($Z^1$)-($Z^{16}$)) via a linker (e.g., a phosphorothioate linkage), wherein the CYP7A1 RNAi agent comprises a sense strand and an antisense strand forming a duplex region, wherein the antisense strand comprises a region of complementarity of at least 15 nucleotides to a CYP7A1 target sequence set forth in nucleosides 113-133, 221-241, 249-269, 290-310, 301-321, 475-495, 476-496, 504-524, 593-613, 600-620, 671-691, 779-799, 839-859, 842-862, 1003-1023, 1009-1029, 1037-1057, 1082-1102,1189-1209, 1207-1227, 1215-1235, 1225-1245, 1226-1246, 1235-1255, 1289-1309, 1296-1316, 1384-1404, 1415-1435, 1431-1451, or 1559-1579 of SEQ ID NO: 1, wherein the region of complementarity comprises a nucleoside sequence that contains no more than 3 mismatches to the CYP7A1 target sequence, and wherein the sense strand is at least substantially complementary to the antisense strand.

In some embodiments, a CYP7A1 RNAi agent described herein is conjugated (e.g., covalently linked) to a targeting moiety comprising a structure of any one of Formula ($Z^1$)-($Z^{16}$) (e.g., Formula ($Z^6$)), wherein the CYP7A1 RNAi agent comprises an antisense strand comprising the nucleobase sequence of any one of SEQ ID Nos: 777-1190 and a sense strand substantially complementary to the antisense strand and comprising the nucleobase sequence of any one of SEQ ID Nos: 393-776, wherein the targeting moiety is conjugated (e.g., covalently linked) to the 3' terminal nucleoside of the sense strand. In some embodiments, the targeting moiety comprises a structure of Formula ($Z^6$).

($Z^6$)

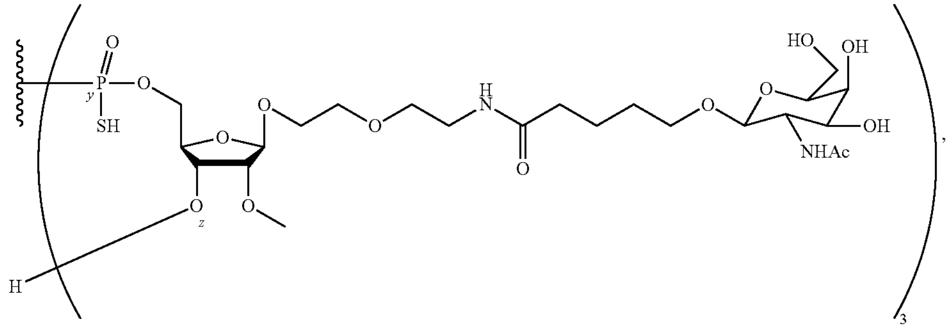, or a pharmaceutically acceptable salt thereof, wherein the

indicates the attachment point that is covalently linked to the 3'-O of the sugar moiety of the 3' terminal nucleoside of the sense strand. For Formula ($Z^6$), with the exception of the phosphorous directly attached to the sense strand, each instance of phosphorous labeled y is bound to the oxygen labeled z of the adjacent unit, and with the exception of the oxygen directly attached to hydrogen, each instance of oxygen labeled z is bound to the phosphorous labeled y of the adjacent unit.

In some embodiments, a CYP7A1 RNAi agent described herein is conjugated (e.g., covalently linked) to a targeting moiety comprising a structure of any one of Formula ($Z^1$)-($Z^{16}$) (e.g., Formula ($Z^6$)), wherein the CYP7A1 RNAi agent comprises nucleobase sequences (e.g., nucleobase sequences of the sense strand and antisense strand) of an siRNA selected from siRNA1-siRNA384, siRNA12', siRNA27', siRNA38', siRNA47', siRNA51', siRNA72', siRNA73', siRNA81', siRNA100', siRNA101', siRNA118', siRNA122', siRNA124', siRNA125', siRNA158', siRNA161', siRNA172', siRNA174', siRNA190', siRNA199', siRNA203', siRNA205', siRNA206', siRNA212', siRNA226', siRNA231', siRNA250', siRNA256', siRNA260', and siRNA272', wherein the targeting moiety is conjugated (e.g., covalently linked) to the 3' terminal nucleoside of the sense strand. In some embodiments, the targeting moiety comprises a structure of Formula ($Z^6$).

($Z^6$)

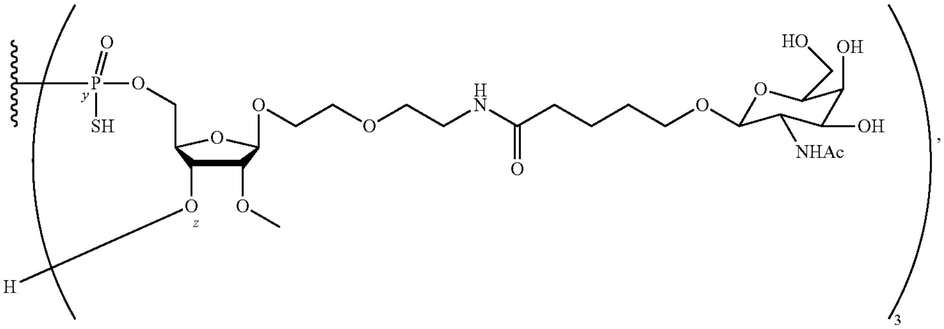, or a pharmaceutically acceptable salt thereof, wherein the

indicates the attachment point that is covalently linked to the 3'-O of the sugar moiety of the 3' terminal nucleoside of the sense strand. For Formula ($Z^6$), with the exception of the phosphorous directly attached to the sense strand, each instance of phosphorous labeled y is bound to the oxygen labeled z of the adjacent unit, and with the exception of the oxygen directly attached to hydrogen, each instance of oxygen labeled z is bound to the phosphorous labeled y of the adjacent unit.

In some embodiments, a CYP7A1 RNAi agent described herein is conjugated (e.g., covalently linked) to a targeting moiety, wherein the CYP7A1 RNAi agent comprises nucleobase sequences (e.g., nucleobase sequences of the sense strand and antisense strand) of an siRNA selected from siRNA12', siRNA27', siRNA38', siRNA47', siRNA51', siRNA72', siRNA73', siRNA81', siRNA100', siRNA101', siRNA118', siRNA122', siRNA124', siRNA125', siRNA158', siRNA161', siRNA172', siRNA174', siRNA190', siRNA199', siRNA203', siRNA205', siRNA206', siRNA212', siRNA226', siRNA231', siRNA250', siRNA256', siRNA260', and siRNA272', wherein the nucleosides at positions 9, 10, 11, 12 (counting 5'→3') of the sense strand are 2'-F modified nucleosides, wherein the nucleosides at positions 2, 3, 5, 7, 8, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages, wherein the targeting moiety is conjugated (e.g., covalently linked) to the 3' terminal nucleoside of the sense strand, and wherein the targeting moiety comprises a structure of Formula ($Z^6$):

or a pharmaceutically acceptable salt thereof, wherein the

indicates the attachment point that is covalently linked to the 3'-O of the sugar moiety of the 3' terminal nucleoside of the sense strand. For Formula ($Z^6$), with the exception of the phosphorous directly attached to the sense strand, each instance of phosphorous labeled y is bound to the oxygen labeled z of the adjacent unit, and with the exception of the oxygen directly attached to hydrogen, each instance of oxygen labeled z is bound to the phosphorous labeled y of the adjacent unit.

In some embodiments, a CYP7A1 RNAi agent described herein is conjugated (e.g., covalently linked) to a targeting moiety, wherein the CYP7A1 RNAi agent comprises nucleobase sequences (e.g., nucleobase sequences of the sense strand and antisense strand) of an siRNA selected from siRNA12', siRNA27', siRNA38', siRNA47', siRNA51', siRNA72', siRNA73', siRNA81', siRNA100', siRNA101', siRNA118', siRNA122', siRNA124', siRNA125', siRNA158', siRNA161', siRNA172', siRNA174', siRNA190', siRNA199', siRNA203', siRNA205', siRNA206', siRNA212', siRNA226', siRNA231', siRNA250', siRNA256', siRNA260', and siRNA272', wherein the nucleosides at positions 9, 10, 11, 12 (counting 5'→3') of the sense strand are 2'-F modified nucleosides, wherein the nucleosides at positions 2, 3, 5, 6, 7, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages, wherein the targeting moiety is conjugated (e.g., covalently linked) to the 3' terminal nucleoside of the sense strand, and wherein the targeting moiety comprises a structure of Formula ($Z^6$):

($Z^6$)

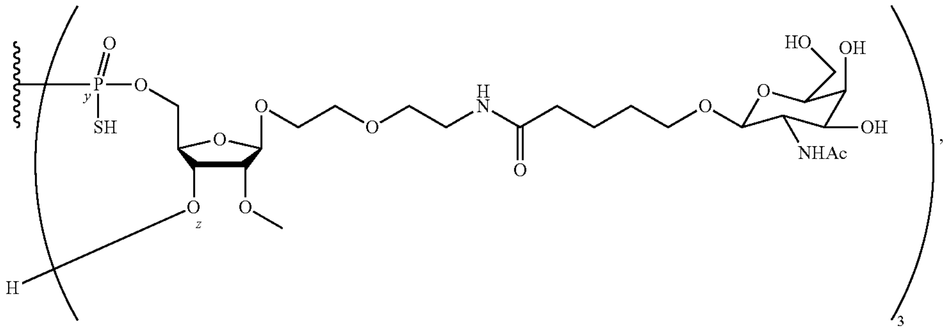

, ($Z^6$)

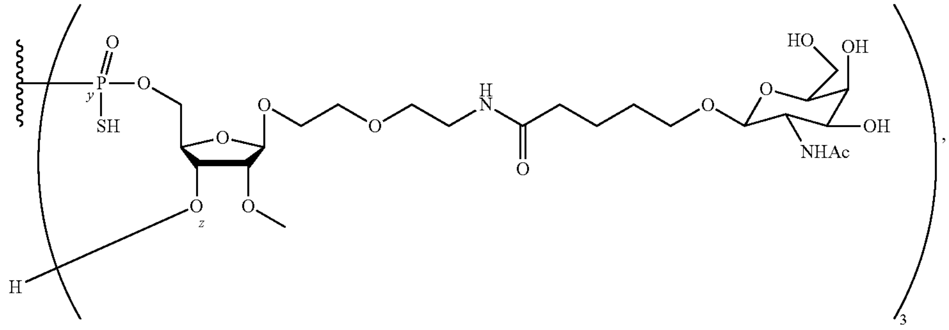

or a pharmaceutically acceptable salt thereof, wherein the

indicates the attachment point that is covalently linked to the 3'-O of the sugar moiety of the 3' terminal nucleoside of the sense strand. For Formula ($Z^6$), with the exception of the phosphorous directly attached to the sense strand, each instance of phosphorous labeled y is bound to the oxygen labeled z of the adjacent unit, and with the exception of the oxygen directly attached to hydrogen, each instance of oxygen labeled z is bound to the phosphorous labeled y of the adjacent unit.

In some embodiments, a CYP7A1 RNAi agent described herein is conjugated (e.g., covalently linked) to a targeting moiety, wherein the CYP7A1 RNAi agent comprises nucleobase sequences (e.g., nucleobase sequences of the sense strand and antisense strand) of an siRNA selected from siRNA12', siRNA27', siRNA38', siRNA47', siRNA51', siRNA72', siRNA73', siRNA81', siRNA100', siRNA101', siRNA118', siRNA122', siRNA124', siRNA125', siRNA158', siRNA161', siRNA172', siRNA174', siRNA190', siRNA199', siRNA203', siRNA205', siRNA206', siRNA212', siRNA226', siRNA231', siRNA250', siRNA256', siRNA260', and siRNA272', wherein the nucleosides at positions 9, 10, 11, 12 (counting 5'→3') of the sense strand are 2'-F modified nucleosides, wherein the nucleosides at positions 2, 3, 5, 6, 7, 8, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages, wherein the targeting moiety is conjugated (e.g., covalently linked) to the 3' terminal nucleoside of the sense strand, and wherein the targeting moiety comprises a structure of Formula ($Z^6$):

($Z^6$)

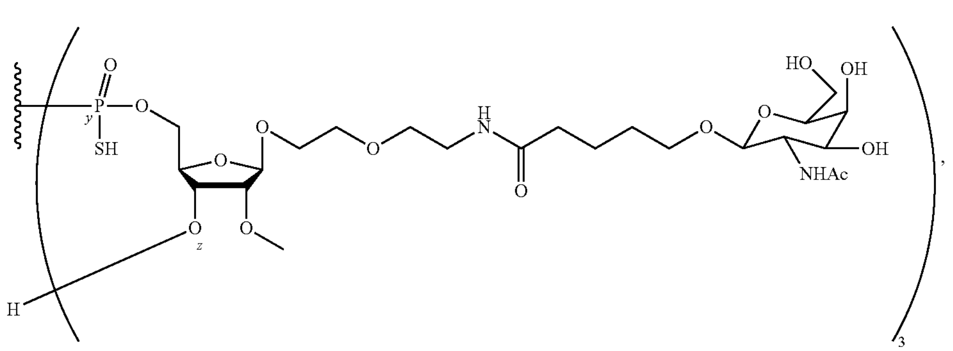

or a pharmaceutically acceptable salt thereof, wherein the

indicates the attachment point that is covalently linked to the 3'-O of the sugar moiety of the 3' terminal nucleoside of the sense strand. For Formula ($Z^6$), with the exception of the phosphorous directly attached to the sense strand, each instance of phosphorous labeled y is bound to the oxygen labeled z of the adjacent unit, and with the exception of the oxygen directly attached to hydrogen, each instance of oxygen labeled z is bound to the phosphorous labeled y of the adjacent unit.

In some embodiments, a CYP7A1 RNAi agent described herein is conjugated (e.g., covalently linked) to a targeting moiety, wherein the CYP7A1 RNAi agent comprises nucleobase sequences (e.g., nucleobase sequences of the sense strand and antisense strand) of an siRNA selected from siRNA12', siRNA27', siRNA38', siRNA47', siRNA51', siRNA72', siRNA73', siRNA81', siRNA100', siRNA101', siRNA118', siRNA122', siRNA124', siRNA125', siRNA158', siRNA161', siRNA172', siRNA174', siRNA190', siRNA199', siRNA203', siRNA205', siRNA206', siRNA212', siRNA226', siRNA231', siRNA250', siRNA256', siRNA260', and siRNA272', wherein the nucleosides at positions 9, 10, 11, 12 (counting 5'→3') of the sense strand are 2'-F modified nucleosides, wherein the nucleosides at positions 2, 3, 7, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages, wherein the targeting moiety is conjugated (e.g., covalently linked) to the 3' terminal nucleoside of the sense strand, and wherein the targeting moiety comprises a structure of Formula ($Z^6$):

or a pharmaceutically acceptable salt thereof, wherein the

indicates the attachment point that is covalently linked to the 3'-O of the sugar moiety of the 3' terminal nucleoside of the sense strand. For Formula ($Z^6$), with the exception of the phosphorous directly attached to the sense strand, each instance of phosphorous labeled y is bound to the oxygen labeled z of the adjacent unit, and with the exception of the oxygen directly attached to hydrogen, each instance of oxygen labeled z is bound to the phosphorous labeled y of the adjacent unit.

In some embodiments, any one of the CYP7A1 RNAi agents described herein is conjugated (e.g., covalently linked) to a targeting moiety, wherein the targeting moiety is conjugated (e.g., covalently linked) to the 3' terminal nucleoside of the sense strand, wherein the targeting moiety comprising a structure of formula:

($Z^6$)

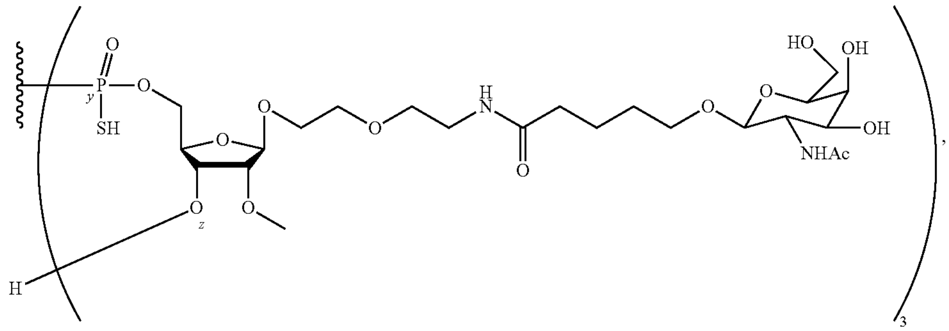

,

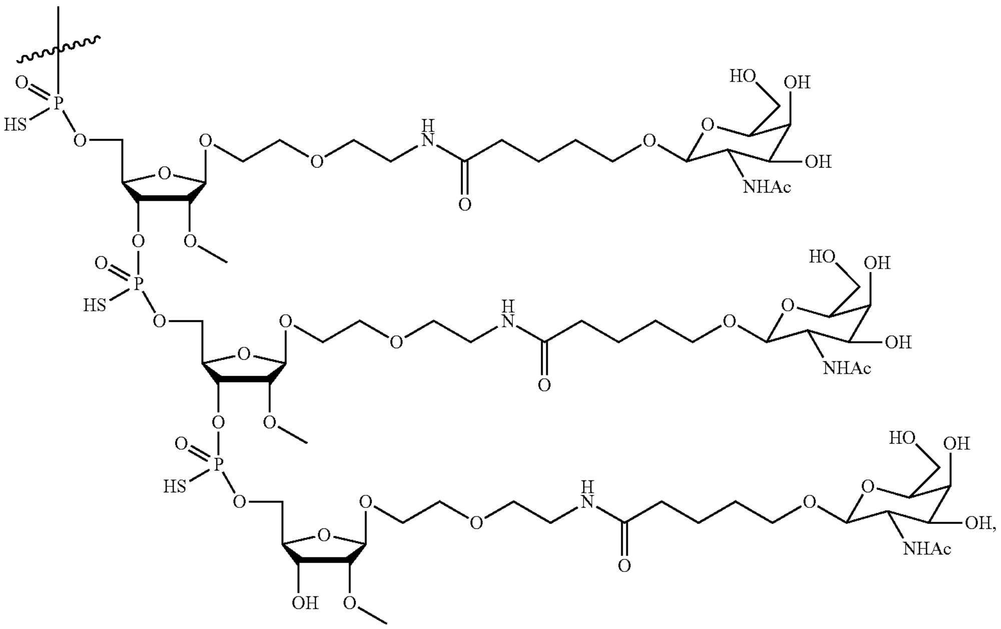

or a pharmaceutically acceptable salt thereof, wherein the

indicates the attachment point that is covalently linked to the 3'-O of the sugar moiety of the 3' terminal nucleoside of the sense strand. In some embodiments, a conjugate described herein comprises a CYP7A1 RNAi agent conjugated (e.g., covalently linked) to a targeting moiety, wherein the targeting moiety is conjugated (e.g., covalently linked) to the 3' terminal nucleoside of the sense strand, wherein the conjugate comprises a structure of:

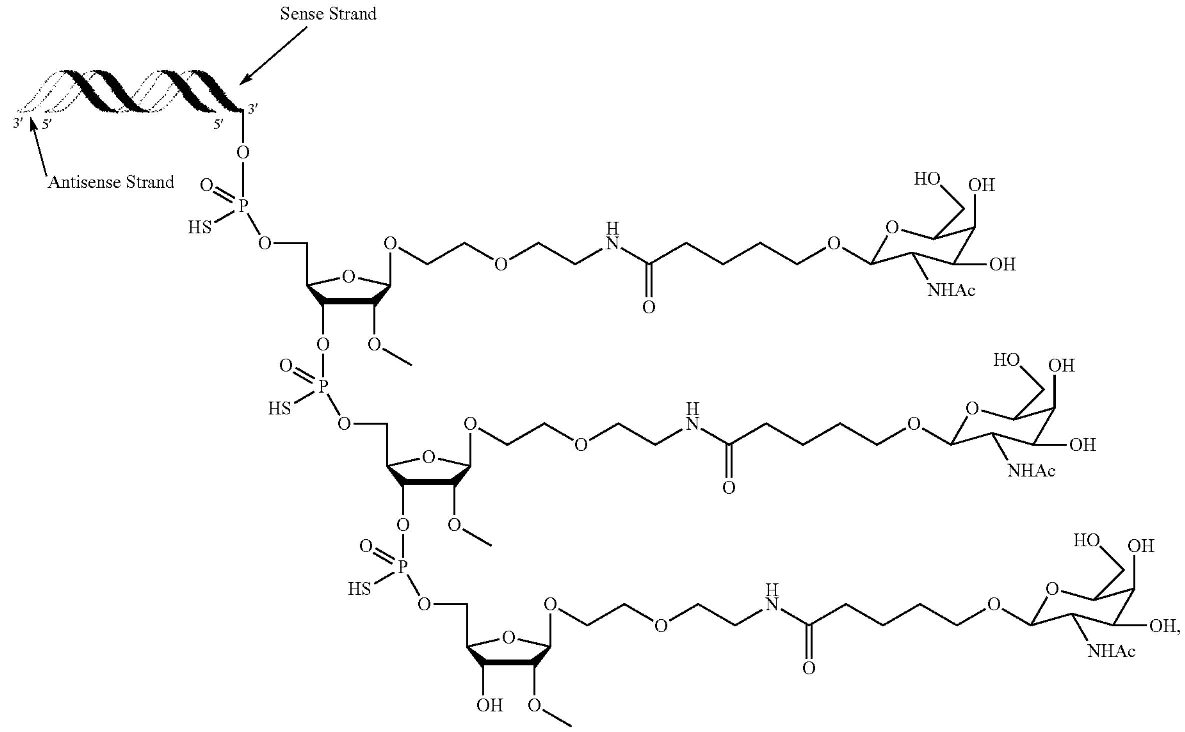

or a pharmaceutically acceptable salt thereof, wherein a CYP7A1 RNAi agent comprises nucleobase sequences (e.g., nucleobase sequences of the sense strand and antisense strand) of an siRNA selected from siRNA1-siRNA384, siRNA12', siRNA27', siRNA38', siRNA47', siRNA51', siRNA72', siRNA73', siRNA81', siRNA100', siRNA101', siRNA118', siRNA122', siRNA124', siRNA125', siRNA158', siRNA161', siRNA172', siRNA174', siRNA190', siRNA199', siRNA203', siRNA205', siRNA206', siRNA212', siRNA226', siRNA231', siRNA250', siRNA256', siRNA260', and siRNA272', and wherein:

(i) the nucleosides at positions 9, 10, 11, 12 (counting 5'→3') of the sense strand are 2'-F modified nucleosides, wherein the nucleosides at positions 2, 3, 5, 7, 8, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages;

(ii) the nucleosides at positions 9, 10, 11, 12 (counting 5'→3') of the sense strand are 2'-F modified nucleosides, wherein the nucleosides at positions 2, 3, 5, 6, 7, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages;

(iii) the nucleosides at positions 9, 10, 11, 12 (counting 5'→3') of the sense strand are 2'-F modified nucleosides, wherein the nucleosides at positions 2, 3, 5, 6, 7, 8, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages; or (iv) the nucleosides at positions 9, 10, 11, 12 (counting 5'→3') of the sense strand are 2'-F modified nucleosides, wherein the nucleosides at positions 2, 3, 7, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages.

In some embodiments, a CYP7A1 RNAi agent described herein comprises:

an antisense strand comprising the nucleobase sequence of SEQ ID NO: 1173 and a structure (5'→3') of

[mUs][fCs][fU][mA][fA][mG][fU][fG][mC][fA][mU][mU][mA][fA][mC][mU][mG][mU][mG][mG][mGs][mAs][mG] (SEQ ID NO: 2016); and a sense strand comprising the nucleobase sequence of SEQ ID NO: 604 and a structure (5'→3') of

```
                                          (SEQ ID NO: 1425)
[mCs][mCs][mC][mA][mC][mA][mG][mU][fU][fA][fA]
[fU][mG][mC][mA][mC][mU][mU][mA][mG][mAs];
```

wherein mA, mC, mG and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage;

and wherein the 3' terminal nucleoside of the sense strand is covalently linked to a targeting moiety comprising a structure of Formula ($Z^6$), wherein the conjugated CYP7A1 RNAi agent comprises a structure as shown below:

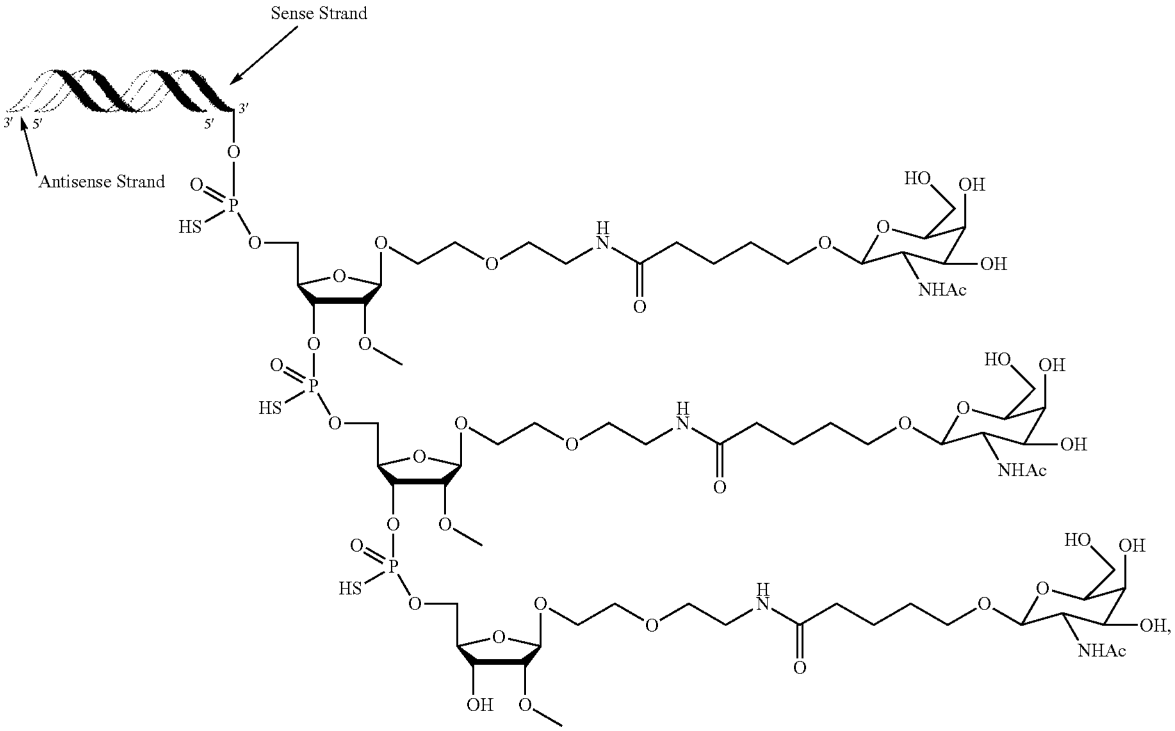

or a pharmaceutically acceptable salt thereof. It is to be understood that the "s" of the 3'-terminal [mAs] of the sense strand corresponds to the phosphorothioate linkage (e.g.,

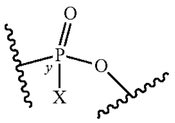
, wherein X is —SH, i.e.,

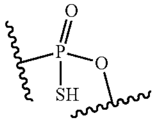
)

of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formula ($Z^6$).

In some embodiments, a CYP7A1 RNAi agent described herein comprises:

an antisense strand comprising the nucleobase sequence of SEQ ID NO: 1174 and a structure (5'→3') of

[mUs][fUs][fU][mA][fA][mC][fU][fG][mU][fG][mG][mG][mU][fA][mA][mA][mG][mA][mG][mC][mUs][mAs][mG] (SEQ ID NO: 2020); and a sense strand comprising the nucleobase sequence of SEQ ID NO: 598 and a structure (5'→3') of (SEQ ID NO: 1418)
[mAs][mGs][mC][mU][mC][mU][mU][mU][fA][fC][fC][fC][mA][mC][mA][mG][mU][mU][mA][mA][mAs], wherein mA, mC, mG and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage;

and wherein the 3' terminal nucleoside of the sense strand is covalently linked to a targeting moiety comprising a structure of Formula ($Z^6$), wherein the conjugated CYP7A1 RNAi agent comprises a structure as shown below:

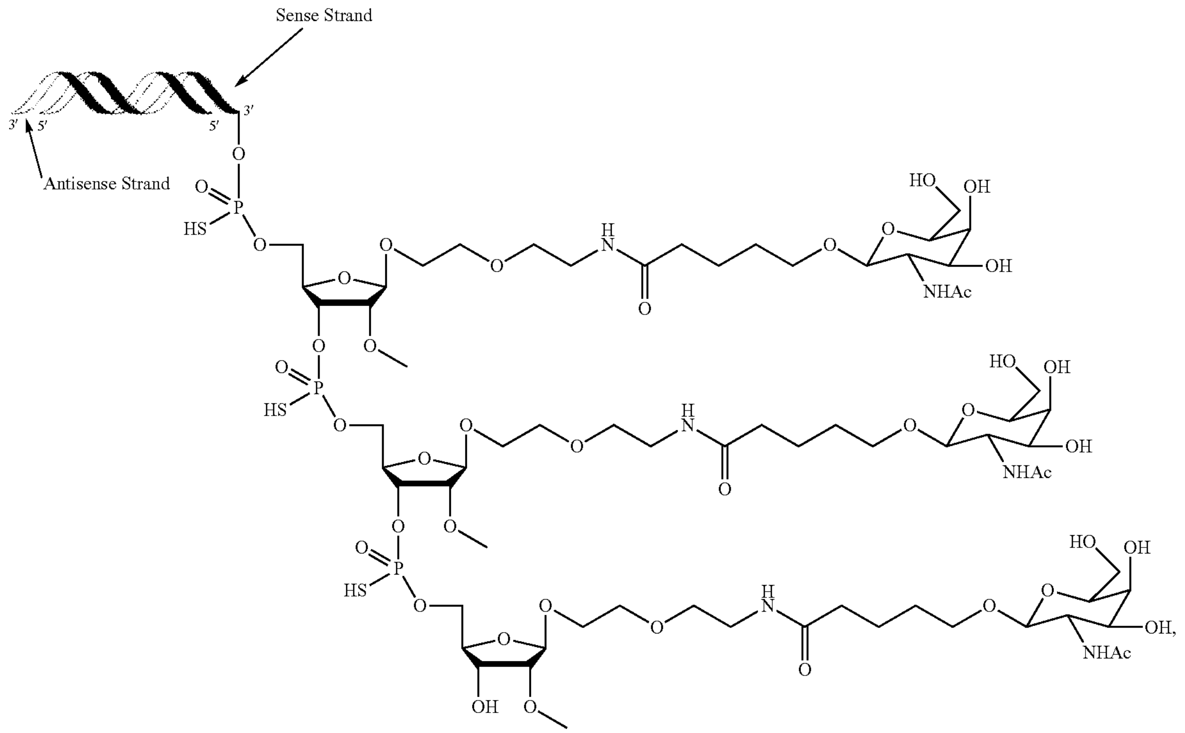

or a pharmaceutically acceptable salt thereof. It is to be understood that the "s" of the 3'-terminal [mAs] of the sense strand corresponds to the phosphorothioate linkage (e.g.,

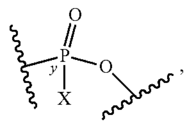

wherein X is —SH, i.e.,

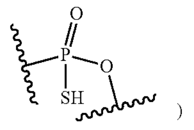

of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formula ($Z^6$).

In some embodiments, a CYP7A1 RNAi agent described herein comprises:

an antisense strand comprising the nucleobase sequence of SEQ ID NO: 1181 and a structure (5'→3') of

[mUs][fUs][fU][mC][fC][fG][fU][mG][mA][fG][mG][mG][mA][fA][mU][mU][mC][mA][mA][mG][mGs][mAs][mG] (SEQ ID NO: 2033); and a sense strand comprising the nucleobase sequence of SEQ ID NO: 464 and a structure (5'→3') of

```
                                    (SEQ ID NO: 1267)
[mCs][mCs][mU][mU][mG][mA][mA][mU][fU][fC][fC]
[fC][mU][mC][mA][mC][mG][mG][mA][mA][mAs],
```

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage;

and wherein the 3' terminal nucleoside of the sense strand is covalently linked to a targeting moiety comprising a structure of Formula ($Z^6$), wherein the conjugated CYP7A1 RNAi agent comprises a structure as shown below:

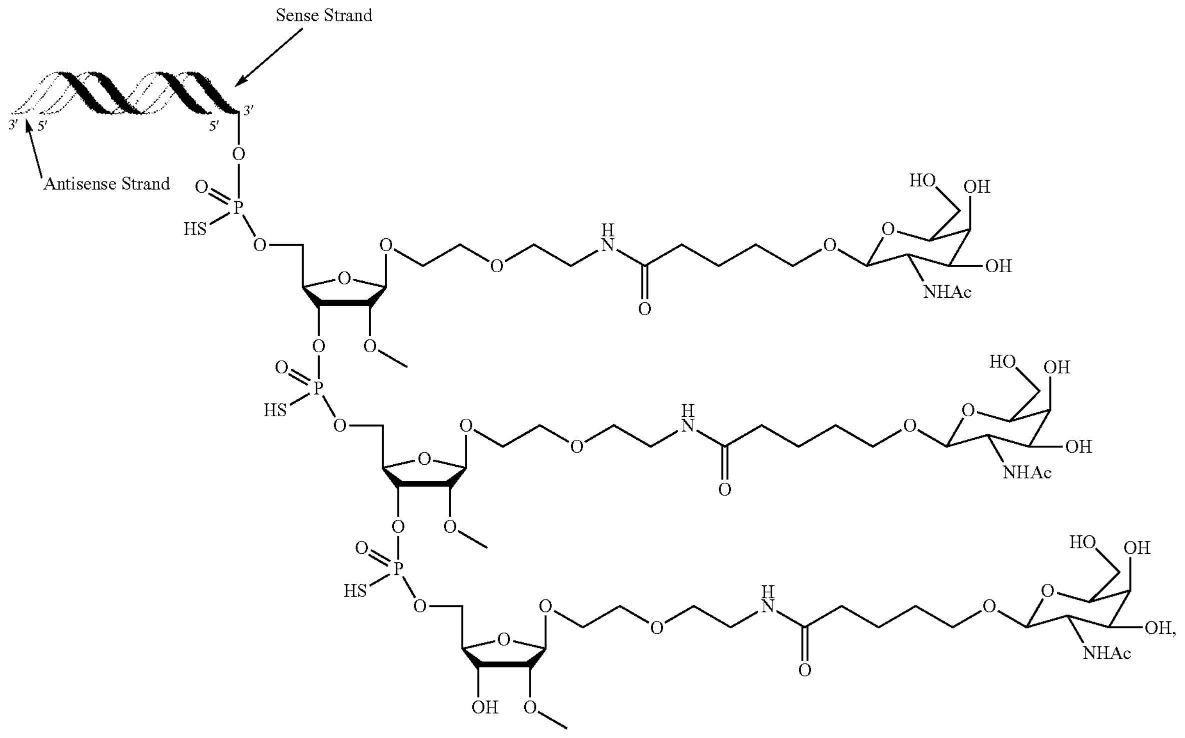

or a pharmaceutically acceptable salt thereof. It is to be understood that the “s” of the 3'-terminal [mAs] of the sense strand corresponds to the phosphorothioate linkage (e.g.,

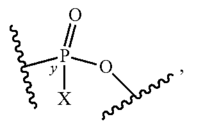

wherein X is —SH, i.e.,

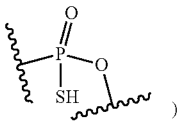

of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formula ($Z^6$).

In some embodiments, an RNAi agent comprising a targeting moiety described herein (e.g., a targeting moiety of Formulae (I), (I-a), (I-a-1), (I-b), (I-b-1), (I-c), (I-c-1), (I-d), (I-d-1), (I-e), (I-e-1), (I-f), (I-f-1), (I-g), (I-h), (I-i), (I-j), (II), (II-a), (II-b), (II-c), (III), (III-a), (IV), (IV-a), (IV-b), (IV-c), (IV-d), (IV-e), (IV-f), or ($Z^1$)-($Z^{16}$)) may be synthesized via including GalNAc-containing phosphoramidite during solids phase synthesis of the sense strand such that the GalNAc-containing repeat units of the targeting moiety is directly added to the 5' or 3' end of the sense strand during synthesis.

Pharmaceutical Compositions

Pharmaceutical compositions comprising one or more RNAi agents (e.g., CYP7A1 RNAi agents), either alone or in combination with prophylactic agents, therapeutic agents, and/or pharmaceutically acceptable carriers are provided. The pharmaceutical compositions comprising RNAi agents (e.g., CYP7A1 RNAi agents) provided herein are for use in, but not limited to, diagnosing, detecting, or monitoring a disease, in preventing, treating, managing, or ameliorating a disease or one or more symptoms thereof, and/or in research. In some embodiments, a pharmaceutical composition may further comprise any other suitable therapeutic agent for treatment of a subject, e.g., a human subject having a CYP7A1 disease or CYP7A1-associated disease. In some embodiments, the other therapeutic agents may enhance or supplement the effectiveness of the complexes described herein. Non-limiting examples of other therapeutic agents include another RNAi agent, a small molecule drug, an antibody, an antibody fragment, peptide and/or aptamer. In some embodiments, the other therapeutic agents may function to treat a different symptom or disease than the CYP7A1 RNAi agents described herein. The formulation of pharmaceutical compositions, either alone or in combination with prophylactic agents, therapeutic agents, and/or pharmaceutically acceptable carriers, are known to one skilled in the art.

An aspect of the disclosure includes pharmaceutical compositions for inhibiting expression of a gene encoding CYP7A1 comprising any one of the RNAi agents (e.g., CYP7A1 RNAi agents) described herein. In some embodiments, an RNAi agent (e.g., CYP7A1 RNAi agent) is in an unbuffered solution. In some embodiments, an RNAi agent (e.g., CYP7A1 RNAi agent) is formulated in water or in an aqueous solution (e.g., water with pH adjustments). In some embodiments, the unbuffered solution is saline. In some embodiments, an RNAi agent (e.g., CYP7A1 RNAi agent) is formulated in a buffer solution such as a phosphate-buffered saline solution, liposome, micellar structure, and capsid. In some embodiments, an RNAi agent (e.g., CYP7A1 RNAi agent) is formulated in a basic buffered aqueous solution (e.g., PBS). In some embodiments, formulations as disclosed herein comprise an excipient. In some embodiments, an excipient confers to a composition improved stability, improved absorption, improved solubility and/or (e.g., and) therapeutic enhancement of the active ingredient. In some embodiments, an excipient is a buffering agent (e.g., sodium citrate, sodium phosphate, a tris base, or sodium hydroxide) or a vehicle (e.g., a buffered solution, petrolatum, dimethyl sulfoxide, or mineral oil). Any one of the described RNAi agents (e.g., CYP7A1 RNAi agents), when added to pharmaceutically acceptable excipients, can be packaged into kits, containers, packs, or dispensers. The pharmaceutical compositions described herein can be packaged in pre-filled syringes or vials.

In some embodiments, the delivery vehicle can be used to deliver a CYP7A1 RNAi agent to a cell or tissue. A delivery vehicle is a compound that improves delivery of a CYP7A1 RNAi agent to a cell or tissue. A delivery vehicle can include, or consist of, but is not limited to: a polymer, such as an amphipathic polymer, a membrane active polymer, a peptide, a melittin peptide, a melittin-like peptide (MLP), a lipid, a reversibly modified polymer or peptide, or a reversibly modified membrane active polyamine. In some embodiments, any one of the CYP7A1 RNAi agents or pharmaceutical compositions described herein can be combined with lipids, nanoparticles, polymers, liposomes, micelles, DPCs or other delivery systems available in the art. The CYP7A1 RNAi agents can also be chemically conjugated to targeting moiety, lipids (including, but not limited to cholesterol and cholesteryl derivatives), nanoparticles, polymers, liposomes, micelles, DPCs (see, for example US2004171044, U.S. Pat. Nos. 8,137,695, 8,313,772, 8,501,930, 8,932,572, 8,933,047, US2016015824, U.S. Pat. Nos. 9,750,819, and 9,561,286, each of which is incorporated herein by reference), or other delivery systems available in the art.

In some embodiments, a pharmaceutical composition is formulated to be compatible with its intended route of administration. Non-limiting examples of routes of administration include intravenous, intramuscular, intraperitoneal, intracerebrospinal, subcutaneous, intra-articular, intrasynovial, or intrathecal routes. In some embodiments, the route of administration is subcutaneous.

Kits

An aspect of the disclosure includes kits comprising any one of the RNAi agents (e.g., CYP7A1 RNAi agents) described herein or a pharmaceutical composition described herein. In some embodiments, the kit further comprises instructions for administration. In some embodiments, the kit is for treating a CYP7A1 disease or a CYP7A1-associated disease described herein. In some embodiments, the kit further comprises an additional agent described herein.

Methods

Some aspects of the present disclosure provide methods for inhibiting or reducing expression level of CYP7A1 (e.g., mRNA level and/or protein level) in a cell. In some embodiments, a method for inhibiting or reducing CYP7A1 expression comprises contacting the cell with any one of the CYP7A1 RNAi agents described herein or any one of the pharmaceutical compositions described herein, thereby inhibiting or reducing expression level (e.g., mRNA level and/or protein level) of the CYP7A1 in the cell. In some embodiments, contacting the cell with any one of the CYP7A1 RNAi agents described herein inhibits the expression level (e.g., mRNA level and/or protein level) of CYP7A1 by at least 40%, 50%, 60%, 70%, 80%, 90%, or 95%, relative to the CYP7A1 level in cells not contacted with a CYP7A1 RNAi agent. In some embodiments, the cell is in vitro (e.g., in a cell culture). In some embodiments, the cell is in vivo (e.g., in a subject).

The disclosure also provides methods of decreasing or reducing the expression level of CYP7A1 (e.g., mRNA level and/or protein level) in a subject compared to baseline pre-treatment levels. In some embodiments, methods comprise administering to the subject an effective amount any one of the CYP7A1 RNAi agents described herein or any one of the pharmaceutical compositions described herein. The expression level (e.g., mRNA level and/or protein level) in the subject is reduced in a cell, group of cells, tissue, blood, and/or other fluid of the subject. In some embodiments, the above described methods further comprise determining the level of CYP7A1 (e.g., mRNA level and/or protein level) in a sample(s) from the subject (e.g., CYP7A1 level in a blood or serum sample(s)). The level of CYP7A1 in a sample may be measured by general methods known in the art.

The Examples disclosed herein set forth generally known methods for assessing inhibition of CYP7A1 expression and reduction in CYP7A1 expression levels. In some embodiments, a CYP7A1 RNAi agent described herein is administered to a subject at an effective concentration sufficient to inhibit activity or expression of CYP7A1 by at least 40%, at least 50%, at least 60%, at least 70%, at least 80%, at least 90% or at least 95% relative to a control, e.g., baseline level of gene expression prior to treatment. Some aspects of the disclosure provide methods of maintaining bile acid homeostasis by preventing overproduction of bile acid in the liver, comprising administering to the subject an effective amount any one of the CYP7A1 RNAi agents described herein or any one of the pharmaceutical compositions described herein.

The disclosure also provides methods for reducing inflammation of the bile ducts in a subject, comprising administering to the subject an effective amount any one of the CYP7A1 RNAi agents described herein or any one of the pharmaceutical compositions described herein. In some embodiments, administering to the subject an effective amount any one of the CYP7A1 RNAi agents described herein or any one of the pharmaceutical compositions described herein, reduces inflammation of the bile ducts in a subject by at least 40%, 50%, 60%, 70%, 80%, 90%, or 95% relative to the baseline level of inflammation.

In some embodiments, in any one of the methods described herein, a subject is non-human primate, or rodent. In some embodiments, a subject is a human. In some embodiments, a subject is a patient, e.g., a human patient that has or is suspected of having a disease. In some embodiments, the subject is a human patient who has or is suspected of having a CYP7A1 disease or CYP7A1-associated disease. In some embodiments, the CYP7A1 disease or CYP7A1-associated disease is a liver disease. In some embodiments, the CYP7A1 disease or CYP7A1-associated disease is a cholestatic liver disease such as primary sclerosing cholangitis (PSC), familial intrahepatic cholestasis (PFIC, including Type 1, PFIC1, Type 2, PFIC2, and Type 3, PFIC3), primary biliary cholangitis (PBC), Alagille syndrome, and biliary atresia, and other liver diseases such as nonalcoholic steatohepatitis (NASH), nonalcoholic fatty liver disease (NAFLD), and alcoholic liver disease (ALD).

An aspect of the disclosure includes a method of treating a subject having a CYP7A1 disease or CYP7A1-associated disease. In some embodiments, the method comprises administering to the subject a therapeutically effective amount of any one of the CYP7A1 RNAi agents described herein or a pharmaceutical composition described herein. In some embodiments the method results in treating the subject having the CYP7A1 disease or CYP7A1-associated disease. In some embodiments, the CYP7A1 disease or CYP7A1-associated disease is a liver disease. In some embodiments, the CYP7A1 disease or CYP7A1-associated disease is a cholestatic liver disease such as primary sclerosing cholangitis (PSC), familial intrahepatic cholestasis (PFIC, including Type 1, PFIC1, Type 2, PFIC2, and Type 3, PFIC3), primary biliary cholangitis (PBC), Alagille syndrome, and biliary atresia, and other liver diseases such as nonalcoholic steatohepatitis (NASH), nonalcoholic fatty liver disease (NAFLD), and alcoholic liver disease (ALD).

An aspect of the disclosure includes treating at least one symptom in a subject having a CYP7A1 disease or CYP7A1-associated disease. In some embodiments, the method comprises administering to the subject an effective amount of any one of the CYP7A1 RNAi agents described herein, or the pharmaceutical composition described herein, thereby treating at least one symptom in the subject having the CYP7A1 disease or CYP7A1-associated disease.

In some embodiments, the CYP7A1 disease or the CYP7A1-associated disease symptoms to be treated by the administration of an effective amount of any one of the CYP7A1 RNAi agents described herein, or the pharmaceutical composition described herein, include, but are not limited to, biochemical symptoms, cellular symptoms, histological symptoms, physiological symptoms and/or medical symptoms. In some embodiments, the CYP7A1 disease or the CYP7A1-associated disease symptoms to be treated by the administration of an effective amount of any one of the CYP7A1 RNAi agents described herein, or the pharmaceutical composition described herein are selected from the group consisting of increased liver enzymes (ALP, ALT, AST, GGT), liver inflammation and scarring (fibrosis), increased liver stiffness, bile duct strictures, cirrhosis, liver failure, need for liver transplantation, portal hypertension, variceal bleeding, jaundice, and pruritus.

In some embodiments, any one of the CYP7A1 RNAi agents or any one of the pharmaceutical compositions described herein are effective in treating CYP7A1 disease and CYP7A1-associated disease. In some embodiments, the CYP7A1 disease or CYP7A1-associated disease is a liver disease. In some embodiments, the CYP7A1 disease or CYP7A1-associated disease is a cholestatic liver disease such as primary sclerosing cholangitis (PSC), familial intrahepatic cholestasis (PFIC, including Type 1, PFIC1, Type 2, PFIC2, and Type 3, PFIC3), primary biliary cholangitis (PBC), Alagille syndrome, and biliary atresia, and other liver diseases such as nonalcoholic steatohepatitis (NASH), nonalcoholic fatty liver disease (NAFLD), and alcoholic liver disease (ALD).

In some embodiments, the above described methods further comprise administering an additional agent for the treatment of a CYP7A1 disease or CYP7A1-associated disease.

Having now described some embodiments in detail, practice of the invention will be more fully understood from the following examples, which are presented herein for illustration only and should not be construed as limiting the invention in any way.

EXAMPLES

Example 1: Identification of Active RNAi Sequences from Preliminary In-Vitro Screening A bioinformatics method assuming a canonical 19mer dsRNA was first employed to generate a potential set of 19 mer-containing antisense oligonucleotides targeting various regions of the human CYP7A1 mRNA transcript that were, in certain instances, also complementary to either cynomolgus monkey, rat, and/or mouse CYP7A1 mRNA.

The sequence of the human CYP7A1 mRNA transcript (NM_000780.4), upon which the 19mer-containing antisense oligonucleotides were designed, is set forth in SEQ ID NO. 1. Of the potential 19mer antisense oligonucleotide sequences generated, 384 were selected for incorporation into chemically modified RNAi agents that could be prepared and evaluated in an in-vitro assay to assess target gene knockdown in primary human hepatocytes expressing CYP7A1. The CYP7A1 19-mer mRNA target sequences are listed in Table 2.

Example 2: siRNA Synthesis

Generic 21/23-mer double stranded siRNAs (Table 5A) were designed based on the target sequences in Table 2. siRNAs with modifications as indicated in Table 5B were prepared by Integrated DNA Technologies Inc. (Iowa, USA) using standard solid phase oligonucleotide synthesis.

Table 5A provides the nucleobase sequences of the siRNAs. It is to be understood that any chemical modification pattern may be applied to the nucleobase sequences of the siRNAs in Table 5A. For example, Table 5B lists the siRNA synthesized for in vitro screening, which all have a modification pattern M0 (the nucleosides at positions 9-13 and 19 in the sense strand are ribonucleosides and the rest of the nucleosides in the sense strand are 2'-O-Me modified nucleosides; the nucleosides at positions 2, 3, 5-10, 13-15, 17, 19, and 20 of the antisense strand are ribonucleosides and the rest of the nucleosides in the antisense strand are 2'O-Me modified nucleosides).

TABLE 5A

Nucleobase sequences of siRNAs used in in vitro screening‡

| Position | siRNA# | Sense (5'-3') | SEQ ID NO: | Antisense (5'-3') | SEQ ID NO |
|---|---|---|---|---|---|
| 34 | siRNA1 | UUCUUCCUCAGAGAUUUUGGA | 393 | UCCAAAAUCUCUGAGGAAGAAUU | 777 |
| 40 | siRNA2 | CUCAGAGAUUUUGGCCUAGAA | 394 | UUCUAGGCCAAAAUCUCUGAGUU | 778 |
| 41 | siRNA3 | UCAGAGAUUUUGGCCUAGAUA | 395 | UAUCUAGGCCAAAAUCUCUGAUU | 779 |
| 42 | siRNA4 | CAGAGAUUUUGGCCUAGAUUA | 396 | UAAUCUAGGCCAAAAUCUCUGUU | 780 |

TABLE 5A-continued

Nucleobase sequences of siRNAs used in in vitro screening‡

| Position | siRNA# | Sense (5'-3') | SEQ ID NO: | Antisense (5'-3') | SEQ ID NO |
|---|---|---|---|---|---|
| 43 | siRNA5 | AGAGAUUUUGGCCUAGAUUUA | 397 | UAAAUCUAGGCCAAAAUCUCUUU | 781 |
| 45 | siRNA6 | AGAUUUUGGCCUAGAUUUGCA | 398 | UGCAAAUCUAGGCCAAAAUCUUU | 782 |
| 105 | siRNA7 | CAGCAUGCUGUUGUCUAUGGA | 399 | UCCAUAGACAACAGCAUGCUGUU | 783 |
| 110 | siRNA8 | UGCUGUUGUCUAUGGCUUAUA | 400 | UAUAAGCCAUAGACAACAGCAUU | 784 |
| 111 | siRNA9 | GCUGUUGUCUAUGGCUUAUUA | 401 | UAAUAAGCCAUAGACAACAGCUU | 785 |
| 112 | siRNA10 | CUGUUGUCUAUGGCUUAUUCA | 402 | UGAAUAAGCCAUAGACAACAGUU | 786 |
| 113 | siRNA11 | UGUUGUCUAUGGCUUAUUCUA | 403 | UAGAAUAAGCCAUAGACAACAUU | 787 |
| 115 | siRNA12 | UUGUCUAUGGCUUAUUCUUGA | 404 | UCAAGAAUAAGCCAUAGACAAUU | 788 |
| 116 | siRNA13 | UGUCUAUGGCUUAUUCUUGGA | 405 | UCCAAGAAUAAGCCAUAGACAUU | 789 |
| 117 | siRNA14 | GUCUAUGGCUUAUUCUUGGAA | 406 | UUCCAAGAAUAAGCCAUAGACUU | 790 |
| 118 | siRNA15 | UCUAUGGCUUAUUCUUGGAAA | 407 | UUUCCAAGAAUAAGCCAUAGAUU | 791 |
| 139 | siRNA16 | UAGGAGAAGGCAAACGGGUGA | 408 | UCACCCGUUUGCCUUCUCCUAUU | 792 |
| 141 | siRNA17 | GGAGAAGGCAAACGGGUGAAA | 409 | UUUCACCCGUUUGCCUUCUCCUU | 793 |
| 142 | siRNA18 | GAGAAGGCAAACGGGUGAACA | 410 | UGUUCACCCGUUUGCCUUCUCUU | 794 |
| 143 | siRNA19 | AGAAGGCAAACGGGUGAACCA | 411 | UGGUUCACCCGUUUGCCUUCUUU | 795 |
| 181 | siRNA20 | AAUUCCAUACCUGGGCUGUGA | 412 | UCACAGCCCAGGUAUGGAAUUUU | 796 |
| 182 | siRNA21 | AUUCCAUACCUGGGCUGUGCA | 413 | UGCACAGCCCAGGUAUGGAAUUU | 797 |
| 183 | siRNA22 | UUCCAUACCUGGGCUGUGCUA | 414 | UAGCACAGCCCAGGUAUGGAAUU | 798 |
| 201 | siRNA23 | CUCUGCAAUUUGGUGCCAAUA | 415 | UAUUGGCACCAAAUUGCAGAGUU | 799 |
| 203 | siRNA24 | CUGCAAUUUGGUGCCAAUCCA | 416 | UGGAUUGGCACCAAAUUGCAGUU | 800 |
| 210 | siRNA25 | UUGGUGCCAAUCCUCUUGAGA | 417 | UCUCAAGAGGAUUGGCACCAAUU | 801 |
| 214 | siRNA26 | UGCCAAUCCUCUUGAGUUCCA | 418 | UGGAACUCAAGAGGAUUGGCAUU | 802 |
| 223 | siRNA27 | UCUUGAGUUCCUCAGAGCAAA | 419 | UUUGCUCUGAGGAACUCAAGAUU | 803 |
| 225 | siRNA28 | UUGAGUUCCUCAGAGCAAAUA | 420 | UAUUUGCUCUGAGGAACUCAAUU | 804 |
| 229 | siRNA29 | GUUCCUCAGAGCAAAUCAAAA | 421 | UUUUGAUUUGCUCUGAGGAACUU | 805 |
| 230 | siRNA30 | UUCCUCAGAGCAAAUCAAAGA | 422 | UCUUUGAUUUGCUCUGAGGAAUU | 806 |
| 236 | siRNA31 | AGAGCAAAUCAAAGGAAACAA | 423 | UUGUUUCCUUUGAUUUGCUCUUU | 807 |
| 238 | siRNA32 | AGCAAAUCAAAGGAAACAUGA | 424 | UCAUGUUUCCUUUGAUUUGCUUU | 808 |
| 242 | siRNA33 | AAUCAAAGGAAACAUGGUCAA | 425 | UUGACCAUGUUUCCUUUGAUUUU | 809 |
| 243 | siRNA34 | AUCAAAGGAAACAUGGUCAUA | 426 | UAUGACCAUGUUUCCUUUGAUUU | 810 |
| 244 | siRNA35 | UCAAAGGAAACAUGGUCAUGA | 427 | UCAUGACCAUGUUUCCUUUGAUU | 811 |
| 245 | siRNA36 | CAAAGGAAACAUGGUCAUGUA | 428 | UACAUGACCAUGUUUCCUUUGUU | 812 |
| 246 | siRNA37 | AAAGGAAACAUGGUCAUGUUA | 429 | UAACAUGACCAUGUUUCCUUUUU | 813 |
| 251 | siRNA38 | AAACAUGGUCAUGUUUUUACA | 430 | UGUAAAAACAUGACCAUGUUUUU | 814 |
| 253 | siRNA39 | ACAUGGUCAUGUUUUUACCUA | 431 | UAGGUAAAAACAUGACCAUGUUU | 815 |
| 254 | siRNA40 | CAUGGUCAUGUUUUUACCUGA | 432 | UCAGGUAAAAACAUGACCAUGUU | 816 |
| 262 | siRNA41 | UGUUUUUACCUGCAAACUAAA | 433 | UUUAGUUUGCAGGUAAAAACAUU | 817 |

TABLE 5A-continued

Nucleobase sequences of siRNAs used in in vitro screening‡

| Position | siRNA# | Sense (5'-3') | SEQ ID NO: | Antisense (5'-3') | SEQ ID NO |
|---|---|---|---|---|---|
| 264 | siRNA42 | UUUUUACCUGCAAACUAAUGA | 434 | UCAUUAGUUUGCAGGUAAAAAUU | 818 |
| 266 | siRNA43 | UUUACCUGCAAACUAAUGGGA | 435 | UCCCAUUAGUUUGCAGGUAAAUU | 819 |
| 267 | siRNA44 | UUACCUGCAAACUAAUGGGAA | 436 | UUCCCAUUAGUUUGCAGGUAAUU | 820 |
| 268 | siRNA45 | UACCUGCAAACUAAUGGGAAA | 437 | UUUCCCAUUAGUUUGCAGGUAUU | 821 |
| 291 | siRNA46 | AUGUCCAUUUCAUCACAAAUA | 438 | UAUUUGUGAUGAAAUGGACAUUU | 822 |
| 292 | siRNA47 | UGUCCAUUUCAUCACAAAUCA | 439 | UGAUUUGUGAUGAAAUGGACAUU | 823 |
| 294 | siRNA48 | UCCAUUUCAUCACAAAUCCCA | 440 | UGGGAUUUGUGAUGAAAUGGAUU | 824 |
| 300 | siRNA49 | UCAUCACAAAUCCCUUGUCAA | 441 | UUGACAAGGGAUUUGUGAUGAUU | 825 |
| 302 | siRNA50 | AUCACAAAUCCCUUGUCAUAA | 442 | UUAUGACAAGGGAUUUGUGAUUU | 826 |
| 303 | siRNA51 | UCACAAAUCCCUUGUCAUACA | 443 | UGUAUGACAAGGGAUUUGUGAUU | 827 |
| 304 | siRNA52 | CACAAAUCCCUUGUCAUACCA | 444 | UGGUAUGACAAGGGAUUUGUGUU | 828 |
| 305 | siRNA53 | ACAAAUCCCUUGUCAUACCAA | 445 | UUGGUAUGACAAGGGAUUUGUUU | 829 |
| 309 | siRNA54 | AUCCCUUGUCAUACCAUAAGA | 446 | UCUUAUGGUAUGACAAGGGAUUU | 830 |
| 310 | siRNA55 | UCCCUUGUCAUACCAUAAGGA | 447 | UCCUUAUGGUAUGACAAGGGAUU | 831 |
| 311 | siRNA56 | CCCUUGUCAUACCAUAAGGUA | 448 | UACCUUAUGGUAUGACAAGGGUU | 832 |
| 312 | siRNA57 | CCUUGUCAUACCAUAAGGUGA | 449 | UCACCUUAUGGUAUGACAAGGUU | 833 |
| 313 | siRNA58 | CUUGUCAUACCAUAAGGUGUA | 450 | UACACCUUAUGGUAUGACAAGUU | 834 |
| 315 | siRNA59 | UGUCAUACCAUAAGGUGUUGA | 451 | UCAACACCUUAUGGUAUGACAUU | 835 |
| 319 | siRNA60 | AUACCAUAAGGUGUUGUGCCA | 452 | UGGCACAACACCUUAUGGUAUUU | 836 |
| 360 | siRNA61 | AAAAAUUUCACUUUGCUACUA | 453 | UAGUAGCAAAGUGAAAUUUUUUU | 837 |
| 363 | siRNA62 | AAUUUCACUUUGCUACUUCUA | 454 | UAGAAGUAGCAAAGUGAAAUUUU | 838 |
| 372 | siRNA63 | UUGCUACUUCUGCGAAGGCAA | 455 | UUGCCUUCGCAGAAGUAGCAAUU | 839 |
| 375 | siRNA64 | CUACUUCUGCGAAGGCAUUUA | 456 | UAAAUGCCUUCGCAGAAGUAGUU | 840 |
| 377 | siRNA65 | ACUUCUGCGAAGGCAUUUGGA | 457 | UCCAAAUGCCUUCGCAGAAGUUU | 841 |
| 390 | siRNA66 | CAUUUGGGCACAGAAGCAUUA | 458 | UAAUGCUUCUGUGCCCAAAUGUU | 842 |
| 392 | siRNA67 | UUUGGGCACAGAAGCAUUGAA | 459 | UUCAAUGCUUCUGUGCCCAAAUU | 843 |
| 394 | siRNA68 | UGGGCACAGAAGCAUUGACCA | 460 | UGGUCAAUGCUUCUGUGCCCAUU | 844 |
| 474 | siRNA69 | AUGCCUUGAAUUCCCUCACGA | 461 | UCGUGAGGGAAUUCAAGGCAUUU | 845 |
| 475 | siRNA70 | UGCCUUGAAUUCCCUCACGGA | 462 | UCCGUGAGGGAAUUCAAGGCAUU | 846 |
| 476 | siRNA71 | GCCUUGAAUUCCCUCACGGAA | 463 | UUCCGUGAGGGAAUUCAAGGCUU | 847 |
| 477 | siRNA72 | CCUUGAAUUCCCUCACGGAAA | 464 | UUUCCGUGAGGGAAUUCAAGGUU | 848 |
| 478 | siRNA73 | CUUGAAUUCCCUCACGGAAAA | 465 | UUUUCCGUGAGGGAAUUCAAGUU | 849 |
| 482 | siRNA74 | AAUUCCCUCACGGAAAGCAUA | 466 | UAUGCUUUCCGUGAGGGAAUUUU | 850 |
| 484 | siRNA75 | UUCCCUCACGGAAAGCAUGAA | 467 | UUCAUGCUUUCCGUGAGGGAAUU | 851 |
| 486 | siRNA76 | CCCUCACGGAAAGCAUGAUGA | 468 | UCAUCAUGCUUUCCGUGAGGGUU | 852 |
| 488 | siRNA77 | CUCACGGAAAGCAUGAUGGAA | 469 | UUCCAUCAUGCUUUCCGUGAGUU | 853 |
| 501 | siRNA78 | UGAUGGAAAACCUCCAACGUA | 470 | UACGUUGGAGGUUUUCCAUCAUU | 854 |

TABLE 5A-continued

Nucleobase sequences of siRNAs used in in vitro screening‡

| Position | siRNA# | Sense (5'-3') | SEQ ID NO: | Antisense (5'-3') | SEQ ID NO |
|---|---|---|---|---|---|
| 503 | siRNA79 | AUGGAAAACCUCCAACGUAUA | 471 | UAUACGUUGGAGGUUUUCCAUUU | 855 |
| 505 | siRNA80 | GGAAAACCUCCAACGUAUCAA | 472 | UUGAUACGUUGGAGGUUUUCCUU | 856 |
| 506 | siRNA81 | GAAAACCUCCAACGUAUCAUA | 473 | UAUGAUACGUUGGAGGUUUUCUU | 857 |
| 507 | siRNA82 | AAAACCUCCAACGUAUCAUGA | 474 | UCAUGAUACGUUGGAGGUUUUUU | 858 |
| 509 | siRNA83 | AACCUCCAACGUAUCAUGAGA | 475 | UCUCAUGAUACGUUGGAGGUUUU | 859 |
| 510 | siRNA84 | ACCUCCAACGUAUCAUGAGAA | 476 | UUCUCAUGAUACGUUGGAGGUUU | 860 |
| 511 | siRNA85 | CCUCCAACGUAUCAUGAGACA | 477 | UGUCUCAUGAUACGUUGGAGGUU | 861 |
| 512 | siRNA86 | CUCCAACGUAUCAUGAGACCA | 478 | UGGUCUCAUGAUACGUUGGAGUU | 862 |
| 513 | siRNA87 | UCCAACGUAUCAUGAGACCUA | 479 | UAGGUCUCAUGAUACGUUGGAUU | 863 |
| 514 | siRNA88 | CCAACGUAUCAUGAGACCUCA | 480 | UGAGGUCUCAUGAUACGUUGGUU | 864 |
| 539 | siRNA89 | UCCUCUAACUCAAAGACCGCA | 481 | UGCGGUCUUUGAGUUAGAGGAUU | 865 |
| 552 | siRNA90 | AGACCGCUGCCUGGGUGACAA | 482 | UUGUCACCCAGGCAGCGGUCUUU | 866 |
| 562 | siRNA91 | CUGGGUGACAGAAGGGAUGUA | 483 | UACAUCCCUUCUGUCACCCAGUU | 867 |
| 563 | siRNA92 | UGGGUGACAGAAGGGAUGUAA | 484 | UUACAUCCCUUCUGUCACCCAUU | 868 |
| 564 | siRNA93 | GGGUGACAGAAGGGAUGUAUA | 485 | UAUACAUCCCUUCUGUCACCCUU | 869 |
| 585 | siRNA94 | CUUUCUGCUACCGAGUGAUGA | 486 | UCAUCACUCGGUAGCAGAAAGUU | 870 |
| 587 | siRNA95 | UUCUGCUACCGAGUGAUGUUA | 487 | UAACAUCACUCGGUAGCAGAAUU | 871 |
| 588 | siRNA96 | UCUGCUACCGAGUGAUGUUUA | 488 | UAAACAUCACUCGGUAGCAGAUU | 872 |
| 589 | siRNA97 | CUGCUACCGAGUGAUGUUUGA | 489 | UCAAACAUCACUCGGUAGCAGUU | 873 |
| 593 | siRNA98 | UACCGAGUGAUGUUUGAAGCA | 490 | UGCUUCAAACAUCACUCGGUAUU | 874 |
| 594 | siRNA99 | ACCGAGUGAUGUUUGAAGCUA | 491 | UAGCUUCAAACAUCACUCGGUUU | 875 |
| 595 | siRNA100 | CCGAGUGAUGUUUGAAGCUGA | 492 | UCAGCUUCAAACAUCACUCGGUU | 876 |
| 602 | siRNA101 | AUGUUUGAAGCUGGGUAUUUA | 493 | UAAAUACCCAGCUUCAAACAUUU | 877 |
| 605 | siRNA102 | UUUGAAGCUGGGUAUUUAACA | 494 | UGUUAAAUACCCAGCUUCAAAUU | 878 |
| 606 | siRNA103 | UUGAAGCUGGGUAUUUAACUA | 495 | UAGUUAAAUACCCAGCUUCAAUU | 879 |
| 607 | siRNA104 | UGAAGCUGGGUAUUUAACUAA | 496 | UUAGUUAAAUACCCAGCUUCAUU | 880 |
| 608 | siRNA105 | GAAGCUGGGUAUUUAACUAUA | 497 | UAUAGUUAAAUACCCAGCUUCUU | 881 |
| 609 | siRNA106 | AAGCUGGGUAUUUAACUAUCA | 498 | UGAUAGUUAAAUACCCAGCUUUU | 882 |
| 610 | siRNA107 | AGCUGGGUAUUUAACUAUCUA | 499 | UAGAUAGUUAAAUACCCAGCUUU | 883 |
| 612 | siRNA108 | CUGGGUAUUUAACUAUCUUUA | 500 | UAAAGAUAGUUAAAUACCCAGUU | 884 |
| 613 | siRNA109 | UGGGUAUUUAACUAUCUUUGA | 501 | UCAAAGAUAGUUAAAUACCCAUU | 885 |
| 653 | siRNA110 | GACACACAGAAAGCACAUAUA | 502 | UAUAUGUGCUUUCUGUGUGUCUU | 886 |
| 663 | siRNA111 | AAGCACAUAUUCUAAACAAUA | 503 | UAUUGUUUAGAAUAUGUGCUUUU | 887 |
| 665 | siRNA112 | GCACAUAUUCUAAACAAUCUA | 504 | UAGAUUGUUUAGAAUAUGUGCUU | 888 |
| 666 | siRNA113 | CACAUAUUCUAAACAAUCUUA | 505 | UAAGAUUGUUUAGAAUAUGUGUU | 889 |
| 667 | siRNA114 | ACAUAUUCUAAACAAUCUUGA | 506 | UCAAGAUUGUUUAGAAUAUGUUU | 890 |
| 669 | siRNA115 | AUAUUCUAAACAAUCUUGACA | 507 | UGUCAAGAUUGUUUAGAAUAUUU | 891 |

TABLE 5A-continued

Nucleobase sequences of siRNAs used in in vitro screening‡

| Position | siRNA# | Sense (5'-3') | SEQ ID NO: | Antisense (5'-3') | SEQ ID NO |
|---|---|---|---|---|---|
| 670 | siRNA116 | UAUUCUAAACAAUCUUGACAA | 508 | UUGUCAAGAUUGUUUAGAAUAUU | 892 |
| 671 | siRNA117 | AUUCUAAACAAUCUUGACAAA | 509 | UUUGUCAAGAUUGUUUAGAAUUU | 893 |
| 673 | siRNA118 | UCUAAACAAUCUUGACAACUA | 510 | UAGUUGUCAAGAUUGUUUAGAUU | 894 |
| 679 | siRNA119 | CAAUCUUGACAACUUCAAGCA | 511 | UGCUUGAAGUUGUCAAGAUUGUU | 895 |
| 712 | siRNA120 | CUUUCCAGCCCUGGUAGCAGA | 512 | UCUGCUACCAGGGCUGGAAAGUU | 896 |
| 771 | siRNA121 | GGGAGAAACUGGCAGAGAGCA | 513 | UGCUCUCUGCCAGUUUCUCCCUU | 897 |
| 781 | siRNA122 | GGCAGAGAGCUUGAGGCACGA | 514 | UCGUGCCUCAAGCUCUCUGCCUU | 898 |
| 788 | siRNA123 | AGCUUGAGGCACGAGAACCUA | 515 | UAGGUUCUCGUGCCUCAAGCUUU | 899 |
| 841 | siRNA124 | CCUGCGCAUGUUUCUCAAUGA | 516 | UCAUUGAGAAACAUGCGCAGGUU | 900 |
| 844 | siRNA125 | GCGCAUGUUUCUCAAUGACAA | 517 | UUGUCAUUGAGAAACAUGCGCUU | 901 |
| 846 | siRNA126 | GCAUGUUUCUCAAUGACACUA | 518 | UAGUGUCAUUGAGAAACAUGCUU | 902 |
| 850 | siRNA127 | GUUUCUCAAUGACACUUUGUA | 519 | UACAAAGUGUCAUUGAGAAACUU | 903 |
| 851 | siRNA128 | UUUCUCAAUGACACUUUGUCA | 520 | UGACAAAGUGUCAUUGAGAAAUU | 904 |
| 852 | siRNA129 | UUCUCAAUGACACUUUGUCCA | 521 | UGGACAAAGUGUCAUUGAGAAUU | 905 |
| 861 | siRNA130 | ACACUUUGUCCACCUUUGAUA | 522 | UAUCAAAGGUGGACAAAGUGUUU | 906 |
| 862 | siRNA131 | CACUUUGUCCACCUUUGAUGA | 523 | UCAUCAAAGGUGGACAAAGUGUU | 907 |
| 901 | siRNA132 | ACACCUCGUGGUCCUCUGGGA | 524 | UCCCAGAGGACCACGAGGUGUUU | 908 |
| 903 | siRNA133 | ACCUCGUGGUCCUCUGGGCAA | 525 | UUGCCCAGAGGACCACGAGGUUU | 909 |
| 904 | siRNA134 | CCUCGUGGUCCUCUGGGCAUA | 526 | UAUGCCCAGAGGACCACGAGGUU | 910 |
| 905 | siRNA135 | CUCGUGGUCCUCUGGGCAUCA | 527 | UGAUGCCCAGAGGACCACGAGUU | 911 |
| 906 | siRNA136 | UCGUGGUCCUCUGGGCAUCGA | 528 | UCGAUGCCCAGAGGACCACGAUU | 912 |
| 912 | siRNA137 | UCCUCUGGGCAUCGCAAGCAA | 529 | UUGCUUGCGAUGCCCAGAGGAUU | 913 |
| 915 | siRNA138 | UCUGGGCAUCGCAAGCAAACA | 530 | UGUUUGCUUGCGAUGCCCAGAUU | 914 |
| 916 | siRNA139 | CUGGGCAUCGCAAGCAAACAA | 531 | UUGUUUGCUUGCGAUGCCCAGUU | 915 |
| 917 | siRNA140 | UGGGCAUCGCAAGCAAACACA | 532 | UGUGUUUGCUUGCGAUGCCCAUU | 916 |
| 920 | siRNA141 | GCAUCGCAAGCAAACACCAUA | 533 | UAUGGUGUUUGCUUGCGAUGCUU | 917 |
| 921 | siRNA142 | CAUCGCAAGCAAACACCAUUA | 534 | UAAUGGUGUUUGCUUGCGAUGUU | 918 |
| 950 | siRNA143 | UUCUGGAGUUUAUUUCAAAUA | 535 | UAUUUGAAAUAAACUCCAGAAUU | 919 |
| 954 | siRNA144 | GGAGUUUAUUUCAAAUGAUUA | 536 | UAAUCAUUUGAAAUAAACUCCUU | 920 |
| 955 | siRNA145 | GAGUUUAUUUCAAAUGAUUAA | 537 | UUAAUCAUUUGAAAUAAACUCUU | 921 |
| 956 | siRNA146 | AGUUUAUUUCAAAUGAUUAGA | 538 | UCUAAUCAUUUGAAAUAAACUUU | 922 |
| 957 | siRNA147 | GUUUAUUUCAAAUGAUUAGGA | 539 | UCCUAAUCAUUUGAAAUAAACUU | 923 |
| 980 | siRNA148 | CCAGAAGCAAUGAAAGCAGCA | 540 | UGCUGCUUUCAUUGCUUCUGGUU | 924 |
| 982 | siRNA149 | AGAAGCAAUGAAAGCAGCUAA | 541 | UUAGCUGCUUUCAUUGCUUCUUU | 925 |
| 983 | siRNA150 | GAAGCAAUGAAAGCAGCUACA | 542 | UGUAGCUGCUUUCAUUGCUUCUU | 926 |
| 988 | siRNA151 | AAUGAAAGCAGCUACUGAAGA | 543 | UCUUCAGUAGCUGCUUUCAUUUU | 927 |
| 989 | siRNA152 | AUGAAAGCAGCUACUGAAGAA | 544 | UUCUUCAGUAGCUGCUUUCAUUU | 928 |

TABLE 5A-continued

Nucleobase sequences of siRNAs used in in vitro screening‡

| Position | siRNA# | Sense (5'-3') | SEQ ID NO: | Antisense (5'-3') | SEQ ID NO |
|---|---|---|---|---|---|
| 992 | siRNA153 | AAAGCAGCUACUGAAGAAGUA | 545 | UACUUCUUCAGUAGCUGCUUUUU | 929 |
| 993 | siRNA154 | AAGCAGCUACUGAAGAAGUGA | 546 | UCACUUCUUCAGUAGCUGCUUUU | 930 |
| 994 | siRNA155 | AGCAGCUACUGAAGAAGUGAA | 547 | UUCACUUCUUCAGUAGCUGCUUU | 931 |
| 995 | siRNA156 | GCAGCUACUGAAGAAGUGAAA | 548 | UUUCACUUCUUCAGUAGCUGCUU | 932 |
| 996 | siRNA157 | CAGCUACUGAAGAAGUGAAAA | 549 | UUUUCACUUCUUCAGUAGCUGUU | 933 |
| 1005 | siRNA158 | AAGAAGUGAAAAGAACAUUAA | 550 | UUAAUGUUCUUUUCACUUCUUUU | 934 |
| 1006 | siRNA159 | AGAAGUGAAAAGAACAUUAGA | 551 | UCUAAUGUUCUUUUCACUUCUUU | 935 |
| 1007 | siRNA160 | GAAGUGAAAAGAACAUUAGAA | 552 | UUCUAAUGUUCUUUUCACUUCUU | 936 |
| 1011 | siRNA161 | UGAAAAGAACAUUAGAGAAUA | 553 | UAUUCUCUAAUGUUCUUUUCAUU | 937 |
| 1012 | siRNA162 | GAAAAGAACAUUAGAGAAUGA | 554 | UCAUUCUCUAAUGUUCUUUUCUU | 938 |
| 1013 | siRNA163 | AAAAGAACAUUAGAGAAUGCA | 555 | UGCAUUCUCUAAUGUUCUUUUUU | 939 |
| 1018 | siRNA164 | AACAUUAGAGAAUGCUGGUCA | 556 | UGACCAGCAUUCUCUAAUGUUUU | 940 |
| 1019 | siRNA165 | ACAUUAGAGAAUGCUGGUCAA | 557 | UUGACCAGCAUUCUCUAAUGUUU | 941 |
| 1020 | siRNA166 | CAUUAGAGAAUGCUGGUCAAA | 558 | UUUGACCAGCAUUCUCUAAUGUU | 942 |
| 1021 | siRNA167 | AUUAGAGAAUGCUGGUCAAAA | 559 | UUUUGACCAGCAUUCUCUAAUUU | 943 |
| 1026 | siRNA168 | AGAAUGCUGGUCAAAAGUCA | 560 | UGACUUUUUGACCAGCAUUCUUU | 944 |
| 1027 | siRNA169 | GAAUGCUGGUCAAAAAGUCAA | 561 | UUGACUUUUUGACCAGCAUUCUU | 945 |
| 1029 | siRNA170 | AUGCUGGUCAAAAAGUCAGCA | 562 | UGCUGACUUUUUGACCAGCAUUU | 946 |
| 1036 | siRNA171 | UCAAAAAGUCAGCUUGGAAGA | 563 | UCUUCCAAGCUGACUUUUUGAUU | 947 |
| 1039 | siRNA172 | AAAAGUCAGCUUGGAAGGCAA | 564 | UUGCCUUCCAAGCUGACUUUUUU | 948 |
| 1042 | siRNA173 | AGUCAGCUUGGAAGGCAAUCA | 565 | UGAUUGCCUUCCAAGCUGACUUU | 949 |
| 1084 | siRNA174 | ACUGAAUGACCUGCCAGUAUA | 566 | UAUACUGGCAGGUCAUUCAGUUU | 950 |
| 1087 | siRNA175 | GAAUGACCUGCCAGUAUUAGA | 567 | UCUAAUACUGGCAGGUCAUUCUU | 951 |
| 1134 | siRNA176 | UUUCCAGUGCCUCCCUCAACA | 568 | UGUUGAGGGAGGCACUGGAAAUU | 952 |
| 1151 | siRNA177 | AACAUCCGGACAGCUAAGGAA | 569 | UUCCUUAGCUGUCCGGAUGUUUU | 953 |
| 1152 | siRNA178 | ACAUCCGGACAGCUAAGGAGA | 570 | UCUCCUUAGCUGUCCGGAUGUUU | 954 |
| 1155 | siRNA179 | UCCGGACAGCUAAGGAGGAUA | 571 | UAUCCUCCUUAGCUGUCCGGAUU | 955 |
| 1158 | siRNA180 | GGACAGCUAAGGAGGAUUUCA | 572 | UGAAAUCCUCCUUAGCUGUCCUU | 956 |
| 1160 | siRNA181 | ACAGCUAAGGAGGAUUUCACA | 573 | UGUGAAAUCCUCCUUAGCUGUUU | 957 |
| 1162 | siRNA182 | AGCUAAGGAGGAUUUCACUUA | 574 | UAAGUGAAAUCCUCCUUAGCUUU | 958 |
| 1165 | siRNA183 | UAAGGAGGAUUUCACUUUGCA | 575 | UGCAAAGUGAAAUCCUCCUUAUU | 959 |
| 1168 | siRNA184 | GGAGGAUUUCACUUUGCACCA | 576 | UGGUGCAAAGUGAAAUCCUCCUU | 960 |
| 1169 | siRNA185 | GAGGAUUUCACUUUGCACCUA | 577 | UAGGUGCAAAGUGAAAUCCUCUU | 961 |
| 1174 | siRNA186 | UUUCACUUUGCACCUUGAGGA | 578 | UCCUCAAGGUGCAAAGUGAAAUU | 962 |
| 1177 | siRNA187 | CACUUUGCACCUUGAGGACGA | 579 | UCGUCCUCAAGGUGCAAAGUGUU | 963 |
| 1178 | siRNA188 | ACUUUGCACCUUGAGGACGGA | 580 | UCCGUCCUCAAGGUGCAAAGUUU | 964 |
| 1189 | siRNA189 | UGAGGACGGUUCCUACAACAA | 581 | UUGUUGUAGGAACCGUCCUCAUU | 965 |

TABLE 5A-continued

| Nucleobase sequences of siRNAs used in in vitro screening‡ | | | | | |
|---|---|---|---|---|---|
| Position | siRNA# | Sense (5'-3') | SEQ ID NO: | Antisense (5'-3') | SEQ ID NO |
| 1191 | siRNA190 | AGGACGGUUCCUACAACAUCA | 582 | UGAUGUUGUAGGAACCGUCCUUU | 966 |
| 1194 | siRNA191 | ACGGUUCCUACAACAUCCGAA | 583 | UUCGGAUGUUGUAGGAACCGUUU | 967 |
| 1196 | siRNA192 | GGUUCCUACAACAUCCGAAAA | 584 | UUUUCGGAUGUUGUAGGAACCUU | 968 |
| 1200 | siRNA193 | CCUACAACAUCCGAAAAGAUA | 585 | UAUCUUUUCGGAUGUUGUAGGUU | 969 |
| 1201 | siRNA194 | CUACAACAUCCGAAAAGAUGA | 586 | UCAUCUUUUCGGAUGUUGUAGUU | 970 |
| 1203 | siRNA195 | ACAACAUCCGAAAAGAUGACA | 587 | UGUCAUCUUUUCGGAUGUUGUUU | 971 |
| 1204 | siRNA196 | CAACAUCCGAAAAGAUGACAA | 588 | UUGUCAUCUUUUCGGAUGUUGUU | 972 |
| 1205 | siRNA197 | AACAUCCGAAAAGAUGACAUA | 589 | UAUGUCAUCUUUUCGGAUGUUUU | 973 |
| 1207 | siRNA198 | CAUCCGAAAAGAUGACAUCAA | 590 | UUGAUGUCAUCUUUUCGGAUGUU | 974 |
| 1209 | siRNA199 | UCCGAAAAGAUGACAUCAUAA | 591 | UUAUGAUGUCAUCUUUUCGGAUU | 975 |
| 1212 | siRNA200 | GAAAAGAUGACAUCAUAGCUA | 592 | UAGCUAUGAUGUCAUCUUUUCUU | 976 |
| 1214 | siRNA201 | AAAGAUGACAUCAUAGCUCUA | 593 | UAGAGCUAUGAUGUCAUCUUUUU | 977 |
| 1215 | siRNA202 | AAGAUGACAUCAUAGCUCUUA | 594 | UAAGAGCUAUGAUGUCAUCUUUU | 978 |
| 1217 | siRNA203 | GAUGACAUCAUAGCUCUUUAA | 595 | UUAAAGAGCUAUGAUGUCAUCUU | 979 |
| 1226 | siRNA204 | AUAGCUCUUUACCCACAGUUA | 596 | UAACUGUGGGUAAAGAGCUAUUU | 980 |
| 1227 | siRNA205 | UAGCUCUUUACCCACAGUUAA | 597 | UUAACUGUGGGUAAAGAGCUAUU | 981 |
| 1228 | siRNA206 | AGCUCUUUACCCACAGUUAAA | 598 | UUUAACUGUGGGUAAAGAGCUUU | 982 |
| 1229 | siRNA207 | GCUCUUUACCCACAGUUAAUA | 599 | UAUUAACUGUGGGUAAAGAGCUU | 983 |
| 1230 | siRNA208 | CUCUUUACCCACAGUUAAUGA | 600 | UCAUUAACUGUGGGUAAAGAGUU | 984 |
| 1231 | siRNA209 | UCUUUACCCACAGUUAAUGCA | 601 | UGCAUUAACUGUGGGUAAAGAUU | 985 |
| 1233 | siRNA210 | UUUACCCACAGUUAAUGCACA | 602 | UGUGCAUUAACUGUGGGUAAAUU | 986 |
| 1236 | siRNA211 | ACCCACAGUUAAUGCACUUAA | 603 | UUAAGUGCAUUAACUGUGGGUUU | 987 |
| 1237 | siRNA212 | CCCACAGUUAAUGCACUUAGA | 604 | UCUAAGUGCAUUAACUGUGGGUU | 988 |
| 1238 | siRNA213 | CCACAGUUAAUGCACUUAGAA | 605 | UUCUAAGUGCAUUAACUGUGGUU | 989 |
| 1239 | siRNA214 | CACAGUUAAUGCACUUAGAUA | 606 | UAUCUAAGUGCAUUAACUGUGUU | 990 |
| 1240 | siRNA215 | ACAGUUAAUGCACUUAGAUCA | 607 | UGAUCUAAGUGCAUUAACUGUUU | 991 |
| 1241 | siRNA216 | CAGUUAAUGCACUUAGAUCCA | 608 | UGGAUCUAAGUGCAUUAACUGUU | 992 |
| 1242 | siRNA217 | AGUUAAUGCACUUAGAUCCAA | 609 | UUGGAUCUAAGUGCAUUAACUUU | 993 |
| 1248 | siRNA218 | UGCACUUAGAUCCAGAAAUCA | 610 | UGAUUUCUGGAUCUAAGUGCAUU | 994 |
| 1249 | siRNA219 | GCACUUAGAUCCAGAAAUCUA | 611 | UAGAUUUCUGGAUCUAAGUGCUU | 995 |
| 1261 | siRNA220 | AGAAAUCUACCCAGACCCUUA | 612 | UAAGGGUCUGGGUAGAUUUCUUU | 996 |
| 1283 | siRNA221 | ACUUUUAAAUAUGAUAGGUAA | 613 | UUACCUAUCAUAUUUAAAAGUUU | 997 |
| 1285 | siRNA222 | UUUUAAAUAUGAUAGGUAUCA | 614 | UGAUACCUAUCAUAUUUAAAAUU | 998 |
| 1286 | siRNA223 | UUUAAAUAUGAUAGGUAUCUA | 615 | UAGAUACCUAUCAUAUUUAAAUU | 999 |
| 1288 | siRNA224 | UAAAUAUGAUAGGUAUCUUGA | 616 | UCAAGAUACCUAUCAUAUUUAUU | 1000 |
| 1290 | siRNA225 | AAUAUGAUAGGUAUCUUGAUA | 617 | UAUCAAGAUACCUAUCAUAUUUU | 1001 |
| 1291 | siRNA226 | AUAUGAUAGGUAUCUUGAUGA | 618 | UCAUCAAGAUACCUAUCAUAUUU | 1002 |

TABLE 5A-continued

| Nucleobase sequences of siRNAs used in in vitro screening‡ | | | | | |
|---|---|---|---|---|---|
| Position | siRNA# | Sense (5'-3') | SEQ ID NO: | Antisense (5'-3') | SEQ ID NO |
| 1292 | siRNA227 | UAUGAUAGGUAUCUUGAUGAA | 619 | UUCAUCAAGAUACCUAUCAUAUU | 1003 |
| 1293 | siRNA228 | AUGAUAGGUAUCUUGAUGAAA | 620 | UUUCAUCAAGAUACCUAUCAUUU | 1004 |
| 1296 | siRNA229 | AUAGGUAUCUUGAUGAAAACA | 621 | UGUUUUCAUCAAGAUACCUAUUU | 1005 |
| 1297 | siRNA230 | UAGGUAUCUUGAUGAAAACGA | 622 | UCGUUUUCAUCAAGAUACCUAUU | 1006 |
| 1298 | siRNA231 | AGGUAUCUUGAUGAAAACGGA | 623 | UCCGUUUUCAUCAAGAUACCUUU | 1007 |
| 1299 | siRNA232 | GGUAUCUUGAUGAAAACGGGA | 624 | UCCCGUUUUCAUCAAGAUACCUU | 1008 |
| 1300 | siRNA233 | GUAUCUUGAUGAAAACGGGAA | 625 | UUCCCGUUUUCAUCAAGAUACUU | 1009 |
| 1301 | siRNA234 | UAUCUUGAUGAAAACGGGAAA | 626 | UUUCCCGUUUUCAUCAAGAUAUU | 1010 |
| 1302 | siRNA235 | AUCUUGAUGAAAACGGGAAGA | 627 | UCUUCCCGUUUUCAUCAAGAUUU | 1011 |
| 1303 | siRNA236 | UCUUGAUGAAAACGGGAAGAA | 628 | UUCUUCCCGUUUUCAUCAAGAUU | 1012 |
| 1306 | siRNA237 | UGAUGAAAACGGGAAGACAAA | 629 | UUUGUCUUCCCGUUUUCAUCAUU | 1013 |
| 1307 | siRNA238 | GAUGAAAACGGGAAGACAAAA | 630 | UUUUGUCUUCCCGUUUUCAUCUU | 1014 |
| 1311 | siRNA239 | AAAACGGGAAGACAAAGACUA | 631 | UAGUCUUUGUCUUCCCGUUUUUU | 1015 |
| 1313 | siRNA240 | AACGGGAAGACAAAGACUACA | 632 | UGUAGUCUUUGUCUUCCCGUUUU | 1016 |
| 1314 | siRNA241 | ACGGGAAGACAAAGACUACCA | 633 | UGGUAGUCUUUGUCUUCCCGUUU | 1017 |
| 1353 | siRNA242 | AGUUAAAGUAUUACUACAUGA | 634 | UCAUGUAGUAAUACUUUAACUUU | 1018 |
| 1354 | siRNA243 | GUUAAAGUAUUACUACAUGCA | 635 | UGCAUGUAGUAAUACUUUAACUU | 1019 |
| 1358 | siRNA244 | AAGUAUUACUACAUGCCCUUA | 636 | UAAGGGCAUGUAGUAAUACUUUU | 1020 |
| 1360 | siRNA245 | GUAUUACUACAUGCCCUUUGA | 637 | UCAAAGGGCAUGUAGUAAUACUU | 1021 |
| 1361 | siRNA246 | UAUUACUACAUGCCCUUUGGA | 638 | UCCAAAGGGCAUGUAGUAAUAUU | 1022 |
| 1363 | siRNA247 | UUACUACAUGCCCUUUGGAUA | 639 | UAUCCAAAGGGCAUGUAGUAAUU | 1023 |
| 1364 | siRNA248 | UACUACAUGCCCUUUGGAUCA | 640 | UGAUCCAAAGGGCAUGUAGUAUU | 1024 |
| 1382 | siRNA249 | UCGGGAGCUACAAUAUGUCCA | 641 | UGGACAUAUUGUAGCUCCCGAUU | 1025 |
| 1386 | siRNA250 | GAGCUACAAUAUGUCCUGGAA | 642 | UUCCAGGACAUAUUGUAGCUCUU | 1026 |
| 1388 | siRNA251 | GCUACAAUAUGUCCUGGAAGA | 643 | UCUUCCAGGACAUAUUGUAGCUU | 1027 |
| 1389 | siRNA252 | CUACAAUAUGUCCUGGAAGAA | 644 | UUCUUCCAGGACAUAUUGUAGUU | 1028 |
| 1413 | siRNA253 | UCGCUAUCCACGAAAUCAAGA | 645 | UCUUGAUUUCGUGGAUAGCGAUU | 1029 |
| 1415 | siRNA254 | GCUAUCCACGAAAUCAAGCAA | 646 | UUGCUUGAUUUCGUGGAUAGCUU | 1030 |
| 1416 | siRNA255 | CUAUCCACGAAAUCAAGCAAA | 647 | UUUGCUUGAUUUCGUGGAUAGUU | 1031 |
| 1417 | siRNA256 | UAUCCACGAAAUCAAGCAAUA | 648 | UAUUGCUUGAUUUCGUGGAUAUU | 1032 |
| 1424 | siRNA257 | GAAAUCAAGCAAUUUUUGAUA | 649 | UAUCAAAAAUUGCUUGAUUUCUU | 1033 |
| 1425 | siRNA258 | AAAUCAAGCAAUUUUUGAUUA | 650 | UAAUCAAAAAUUGCUUGAUUUUU | 1034 |
| 1431 | siRNA259 | AGCAAUUUUUGAUUCUGAUGA | 651 | UCAUCAGAAUCAAAAAUUGCUUU | 1035 |
| 1433 | siRNA260 | CAAUUUUUGAUUCUGAUGCUA | 652 | UAGCAUCAGAAUCAAAAAUUGUU | 1036 |
| 1506 | siRNA261 | ACCAGUCCCGGGCAGGCUUGA | 653 | UCAAGCCUGCCCGGGACUGGUUU | 1037 |
| 1507 | siRNA262 | CCAGUCCCGGGCAGGCUUGGA | 654 | UCCAAGCCUGCCCGGGACUGGUU | 1038 |
| 1510 | siRNA263 | GUCCCGGGCAGGCUUGGGCAA | 655 | UUGCCCAAGCCUGCCCGGGACUU | 1039 |

TABLE 5A-continued

Nucleobase sequences of siRNAs used in in vitro screening‡

| Position | siRNA# | Sense (5'-3') | SEQ ID NO: | Antisense (5'-3') | SEQ ID NO |
|---|---|---|---|---|---|
| 1511 | siRNA264 | UCCCGGGCAGGCUUGGGCAUA | 656 | UAUGCCCAAGCCUGCCCGGGAUU | 1040 |
| 1513 | siRNA265 | CCGGGCAGGCUUGGGCAUUUA | 657 | UAAAUGCCCAAGCCUGCCCGGUU | 1041 |
| 1518 | siRNA266 | CAGGCUUGGGCAUUUUGCCGA | 658 | UCGGCAAAAUGCCCAAGCCUGUU | 1042 |
| 1555 | siRNA267 | AUUUAAAUAUAAAUUCAAGCA | 659 | UGCUUGAAUUUAUAUUUAAAUUU | 1043 |
| 1556 | siRNA268 | UUUAAAUAUAAAUUCAAGCAA | 660 | UUGCUUGAAUUUAUAUUUAAAUU | 1044 |
| 1557 | siRNA269 | UUAAAUAUAAAUUCAAGCAUA | 661 | UAUGCUUGAAUUUAUAUUUAAUU | 1045 |
| 1558 | siRNA270 | UAAAUAUAAAUUCAAGCAUUA | 662 | UAAUGCUUGAAUUUAUAUUUAUU | 1046 |
| 1559 | siRNA271 | AAAUAUAAAUUCAAGCAUUUA | 663 | UAAAUGCUUGAAUUUAUAUUUUU | 1047 |
| 1561 | siRNA272 | AUAUAAAUUCAAGCAUUUGUA | 664 | UACAAAUGCUUGAAUUUAUAUUU | 1048 |
| 1593 | siRNA273 | GGAAUAAGAGGACACUAGAUA | 665 | UAUCUAGUGUCCUCUUAUUCCUU | 1049 |
| 1594 | siRNA274 | GAAUAAGAGGACACUAGAUGA | 666 | UCAUCUAGUGUCCUCUUAUUCUU | 1050 |
| 1597 | siRNA275 | UAAGAGGACACUAGAUGAUAA | 667 | UUAUCAUCUAGUGUCCUCUUAUU | 1051 |
| 1599 | siRNA276 | AGAGGACACUAGAUGAUAUUA | 668 | UAAUAUCAUCUAGUGUCCUCUUU | 1052 |
| 1601 | siRNA277 | AGGACACUAGAUGAUAUUACA | 669 | UGUAAUAUCAUCUAGUGUCCUUU | 1053 |
| 1605 | siRNA278 | CACUAGAUGAUAUUACAGGAA | 670 | UUCCUGUAAUAUCAUCUAGUGUU | 1054 |
| 1606 | siRNA279 | ACUAGAUGAUAUUACAGGACA | 671 | UGUCCUGUAAUAUCAUCUAGUUU | 1055 |
| 1609 | siRNA280 | AGAUGAUAUUACAGGACUGCA | 672 | UGCAGUCCUGUAAUAUCAUCUUU | 1056 |
| 1610 | siRNA281 | GAUGAUAUUACAGGACUGCAA | 673 | UUGCAGUCCUGUAAUAUCAUCUU | 1057 |
| 1614 | siRNA282 | AUAUUACAGGACUGCAGAACA | 674 | UGUUCUGCAGUCCUGUAAUAUUU | 1058 |
| 1638 | siRNA283 | UCACCACACAGUCCCUUUGGA | 675 | UCCAAAGGGACUGUGUGGUGAUU | 1059 |
| 1660 | siRNA284 | AAAUGCAUUUAGUGGUGGUAA | 676 | UUACCACCACUAAAUGCAUUUUU | 1060 |
| 1661 | siRNA285 | AAUGCAUUUAGUGGUGGUAGA | 677 | UCUACCACCACUAAAUGCAUUUU | 1061 |
| 1662 | siRNA286 | AUGCAUUUAGUGGUGGUAGAA | 678 | UUCUACCACCACUAAAUGCAUUU | 1062 |
| 1663 | siRNA287 | UGCAUUUAGUGGUGGUAGAAA | 679 | UUUCUACCACCACUAAAUGCAUU | 1063 |
| 1669 | siRNA288 | UAGUGGUGGUAGAAAUGAUUA | 680 | UAAUCAUUUCUACCACCACUAUU | 1064 |
| 1671 | siRNA289 | GUGGUGGUAGAAAUGAUUCAA | 681 | UUGAAUCAUUUCUACCACCACUU | 1065 |
| 1673 | siRNA290 | GGUGGUAGAAAUGAUUCACCA | 682 | UGGUGAAUCAUUUCUACCACCUU | 1066 |
| 1676 | siRNA291 | GGUAGAAAUGAUUCACCAGGA | 683 | UCCUGGUGAAUCAUUUCUACCUU | 1067 |
| 1683 | siRNA292 | AUGAUUCACCAGGUCCAAUGA | 684 | UCAUUGGACCUGGUGAAUCAUUU | 1068 |
| 1686 | siRNA293 | AUUCACCAGGUCCAAUGUUGA | 685 | UCAACAUUGGACCUGGUGAAUUU | 1069 |
| 1689 | siRNA294 | CACCAGGUCCAAUGUUGUUCA | 686 | UGAACAACAUUGGACCUGGUGUU | 1070 |
| 1690 | siRNA295 | ACCAGGUCCAAUGUUGUUCAA | 687 | UUGAACAACAUUGGACCUGGUUU | 1071 |
| 1692 | siRNA296 | CAGGUCCAAUGUUGUUCACCA | 688 | UGGUGAACAACAUUGGACCUGUU | 1072 |
| 1712 | siRNA297 | AGUGCUUGCUUGUGAAUCUUA | 689 | UAAGAUUCACAAGCAAGCACUUU | 1073 |
| 1713 | siRNA298 | GUGCUUGCUUGUGAAUCUUAA | 690 | UUAAGAUUCACAAGCAAGCACUU | 1074 |
| 1769 | siRNA299 | UCUGCUAGUGAAAAGAACUAA | 691 | UUAGUUCUUUUCACUAGCAGAUU | 1075 |
| 1770 | siRNA300 | CUGCUAGUGAAAAGAACUAGA | 692 | UCUAGUUCUUUUCACUAGCAGUU | 1076 |

TABLE 5A-continued

Nucleobase sequences of siRNAs used in in vitro screening‡

| Position | siRNA# | Sense (5'-3') | SEQ ID NO: | Antisense (5'-3') | SEQ ID NO |
|---|---|---|---|---|---|
| 1824 | siRNA301 | UAAGUCCAUGAAUGUUCAUAA | 693 | UUAUGAACAUUCAUGGACUUAUU | 1077 |
| 1825 | siRNA302 | AAGUCCAUGAAUGUUCAUAUA | 694 | UAUAUGAACAUUCAUGGACUUUU | 1078 |
| 1826 | siRNA303 | AGUCCAUGAAUGUUCAUAUAA | 695 | UUAUAUGAACAUUCAUGGACUUU | 1079 |
| 1827 | siRNA304 | GUCCAUGAAUGUUCAUAUAGA | 696 | UCUAUAUGAACAUUCAUGGACUU | 1080 |
| 1828 | siRNA305 | UCCAUGAAUGUUCAUAUAGCA | 697 | UGCUAUAUGAACAUUCAUGGAUU | 1081 |
| 1829 | siRNA306 | CCAUGAAUGUUCAUAUAGCCA | 698 | UGGCUAUAUGAACAUUCAUGGUU | 1082 |
| 1830 | siRNA307 | CAUGAAUGUUCAUAUAGCCAA | 699 | UUGGCUAUAUGAACAUUCAUGUU | 1083 |
| 1895 | siRNA308 | UUUUUUUCAAAAUGAAGAUAA | 700 | UUAUCUUCAUUUUGAAAAAAAUU | 1084 |
| 2052 | siRNA309 | UGUAUUCUAAUUGGCAGAUUA | 701 | UAAUCUGCCAAUUAGAAUACAUU | 1085 |
| 2053 | siRNA310 | GUAUUCUAAUUGGCAGAUUGA | 702 | UCAAUCUGCCAAUUAGAAUACUU | 1086 |
| 2075 | siRNA311 | UUUUCCUAAGGAAACUGCUUA | 703 | UAAGCAGUUUCCUUAGGAAAAUU | 1087 |
| 2127 | siRNA312 | AAAUGUUCAAAUUCACGUUCA | 704 | UGAACGUGAAUUUGAACAUUUUU | 1088 |
| 2128 | siRNA313 | AAUGUUCAAAUUCACGUUCUA | 705 | UAGAACGUGAAUUUGAACAUUUU | 1089 |
| 2132 | siRNA314 | UUCAAAUUCACGUUCUAGUGA | 706 | UCACUAGAACGUGAAUUUGAAUU | 1090 |
| 2133 | siRNA315 | UCAAAUUCACGUUCUAGUGAA | 707 | UUCACUAGAACGUGAAUUUGAUU | 1091 |
| 2134 | siRNA316 | CAAAUUCACGUUCUAGUGAAA | 708 | UUUCACUAGAACGUGAAUUUGUU | 1092 |
| 2135 | siRNA317 | AAAUUCACGUUCUAGUGAAAA | 709 | UUUUCACUAGAACGUGAAUUUUU | 1093 |
| 2136 | siRNA318 | AAUUCACGUUCUAGUGAAACA | 710 | UGUUUCACUAGAACGUGAAUUUU | 1094 |
| 2137 | siRNA319 | AUUCACGUUCUAGUGAAACUA | 711 | UAGUUUCACUAGAACGUGAAUUU | 1095 |
| 2139 | siRNA320 | UCACGUUCUAGUGAAACUGCA | 712 | UGCAGUUUCACUAGAACGUGAUU | 1096 |
| 2140 | siRNA321 | CACGUUCUAGUGAAACUGCAA | 713 | UUGCAGUUUCACUAGAACGUGUU | 1097 |
| 2144 | siRNA322 | UUCUAGUGAAACUGCAUUAUA | 714 | UAUAAUGCAGUUUCACUAGAAUU | 1098 |
| 2189 | siRNA323 | CGGGUGUGAUCAUAUAUCAUA | 715 | UAUGAUAUAUGAUCACACCCGUU | 1099 |
| 2190 | siRNA324 | GGGUGUGAUCAUAUAUCAUAA | 716 | UUAUGAUAUAUGAUCACACCCUU | 1100 |
| 2191 | siRNA325 | GGUGUGAUCAUAUAUCAUAAA | 717 | UUUAUGAUAUAUGAUCACACCUU | 1101 |
| 2192 | siRNA326 | GUGUGAUCAUAUAUCAUAAAA | 718 | UUUUAUGAUAUAUGAUCACACUU | 1102 |
| 2193 | siRNA327 | UGUGAUCAUAUAUCAUAAAGA | 719 | UCUUUAUGAUAUAUGAUCACAUU | 1103 |
| 2194 | siRNA328 | GUGAUCAUAUAUCAUAAAGGA | 720 | UCCUUUAUGAUAUAUGAUCACUU | 1104 |
| 2195 | siRNA329 | UGAUCAUAUAUCAUAAAGGAA | 721 | UUCCUUUAUGAUAUAUGAUCAUU | 1105 |
| 2199 | siRNA330 | CAUAUAUCAUAAAGGAUAUUA | 722 | UAAUAUCCUUUAUGAUAUAUGUU | 1106 |
| 2209 | siRNA331 | AAAGGAUAUUUCAAAUGAUUA | 723 | UAAUCAUUUGAAAUAUCCUUUUU | 1107 |
| 2210 | siRNA332 | AAGGAUAUUUCAAAUGAUUAA | 724 | UUAAUCAUUUGAAAUAUCCUUUU | 1108 |
| 2211 | siRNA333 | AGGAUAUUUCAAAUGAUUAUA | 725 | UAUAAUCAUUUGAAAUAUCCUUU | 1109 |
| 2215 | siRNA334 | UAUUUCAAAUGAUUAUGAUUA | 726 | UAAUCAUAAUCAUUUGAAAUAUU | 1110 |
| 2216 | siRNA335 | AUUUCAAAUGAUUAUGAUUAA | 727 | UUAAUCAUAAUCAUUUGAAAUUU | 1111 |
| 2217 | siRNA336 | UUUCAAAUGAUUAUGAUUAGA | 728 | UCUAAUCAUAAUCAUUUGAAAUU | 1112 |
| 2218 | siRNA337 | UUCAAAUGAUUAUGAUUAGUA | 729 | UACUAAUCAUAAUCAUUUGAAUU | 1113 |

TABLE 5A-continued

Nucleobase sequences of siRNAs used in in vitro screening‡

| Position | siRNA# | Sense (5'-3') | SEQ ID NO: | Antisense (5'-3') | SEQ ID NO |
|---|---|---|---|---|---|
| 2220 | siRNA338 | CAAAUGAUUAUGAUUAGUUAA | 730 | UUAACUAAUCAUAAUCAUUUGUU | 1114 |
| 2221 | siRNA339 | AAAUGAUUAUGAUUAGUUAUA | 731 | UAUAACUAAUCAUAAUCAUUUUU | 1115 |
| 2223 | siRNA340 | AUGAUUAUGAUUAGUUAUGUA | 732 | UACAUAACUAAUCAUAAUCAUUU | 1116 |
| 2224 | siRNA341 | UGAUUAUGAUUAGUUAUGUCA | 733 | UGACAUAACUAAUCAUAAUCAUU | 1117 |
| 2225 | siRNA342 | GAUUAUGAUUAGUUAUGUCUA | 734 | UAGACAUAACUAAUCAUAAUCUU | 1118 |
| 2313 | siRNA343 | UUGAUUUCCCAAAAACACUAA | 735 | UUAGUGUUUUUGGGAAAUCAAUU | 1119 |
| 2316 | siRNA344 | AUUUCCCAAAAACACUAAAGA | 736 | UCUUUAGUGUUUUUGGGAAAUUU | 1120 |
| 2317 | siRNA345 | UUUCCCAAAAACACUAAAGGA | 737 | UCCUUUAGUGUUUUUGGGAAAUU | 1121 |
| 2319 | siRNA346 | UCCCAAAAACACUAAAGGUGA | 738 | UCACCUUUAGUGUUUUUGGGAUU | 1122 |
| 2320 | siRNA347 | CCCAAAAACACUAAAGGUGGA | 739 | UCCACCUUUAGUGUUUUUGGGUU | 1123 |
| 2321 | siRNA348 | CCAAAAACACUAAAGGUGGUA | 740 | UACCACCUUUAGUGUUUUUGGUU | 1124 |
| 2353 | siRNA349 | UCAUGUUUUAACUUAUUGUUA | 741 | UAACAAUAAGUUAAAACAUGAUU | 1125 |
| 2355 | siRNA350 | AUGUUUUAACUUAUUGUUGCA | 742 | UGCAACAAUAAGUUAAAACAUUU | 1126 |
| 2356 | siRNA351 | UGUUUUAACUUAUUGUUGCUA | 743 | UAGCAACAAUAAGUUAAAACAUU | 1127 |
| 2362 | siRNA352 | AACUUAUUGUUGCUGAAAACA | 744 | UGUUUUCAGCAACAAUAAGUUUU | 1128 |
| 2364 | siRNA353 | CUUAUUGUUGCUGAAAACUCA | 745 | UGAGUUUUCAGCAACAAUAAGUU | 1129 |
| 2365 | siRNA354 | UUAUUGUUGCUGAAAACUCUA | 746 | UAGAGUUUUCAGCAACAAUAAUU | 1130 |
| 2366 | siRNA355 | UAUUGUUGCUGAAAACUCUAA | 747 | UUAGAGUUUUCAGCAACAAUAUU | 1131 |
| 2370 | siRNA356 | GUUGCUGAAAACUCUAUGUCA | 748 | UGACAUAGAGUUUUCAGCAACUU | 1132 |
| 2503 | siRNA357 | AAAAAUGUAGCUUUUAUGUGA | 749 | UCACAUAAAAGCUACAUUUUUUU | 1133 |
| 2562 | siRNA358 | GGAAGCUUUGGUUAUGAAACA | 750 | UGUUUCAUAACCAAAGCUUCCUU | 1134 |
| 2563 | siRNA359 | GAAGCUUUGGUUAUGAAACAA | 751 | UUGUUUCAUAACCAAAGCUUCUU | 1135 |
| 2620 | siRNA360 | AUUUAAAUGCUUUUUAUCGCA | 752 | UGCGAUAAAAAGCAUUUAAAUUU | 1136 |
| 2621 | siRNA361 | UUUAAAUGCUUUUUAUCGCUA | 753 | UAGCGAUAAAAAGCAUUUAAAUU | 1137 |
| 2622 | siRNA362 | UUAAAUGCUUUUUAUCGCUAA | 754 | UUAGCGAUAAAAAGCAUUUAAUU | 1138 |
| 2623 | siRNA363 | UAAAUGCUUUUUAUCGCUAAA | 755 | UUUAGCGAUAAAAAGCAUUUAUU | 1139 |
| 2624 | siRNA364 | AAAUGCUUUUUAUCGCUAAAA | 756 | UUUUAGCGAUAAAAAGCAUUUUU | 1140 |
| 2625 | siRNA365 | AAUGCUUUUUAUCGCUAAAUA | 757 | UAUUUAGCGAUAAAAAGCAUUUU | 1141 |
| 2629 | siRNA366 | CUUUUUAUCGCUAAAUGACUA | 758 | UAGUCAUUUAGCGAUAAAAAGUU | 1142 |
| 2630 | siRNA367 | UUUUUAUCGCUAAAUGACUUA | 759 | UAAGUCAUUUAGCGAUAAAAAUU | 1143 |
| 2632 | siRNA368 | UUUAUCGCUAAAUGACUUGCA | 760 | UGCAAGUCAUUUAGCGAUAAAUU | 1144 |
| 2633 | siRNA369 | UUAUCGCUAAAUGACUUGCAA | 761 | UUGCAAGUCAUUUAGCGAUAAUU | 1145 |
| 2635 | siRNA370 | AUCGCUAAAUGACUUGCAGAA | 762 | UUCUGCAAGUCAUUUAGCGAUUU | 1146 |
| 2639 | siRNA371 | CUAAAUGACUUGCAGAUGAAA | 763 | UUUCAUCUGCAAGUCAUUUAGUU | 1147 |
| 2679 | siRNA372 | UGUUUAAAUGCUGUGUACAAA | 764 | UUUGUACACAGCAUUUAAACAUU | 1148 |
| 2682 | siRNA373 | UUAAAUGCUGUGUACAACAAA | 765 | UUUGUUGUACACAGCAUUUAAUU | 1149 |
| 2683 | siRNA374 | UAAAUGCUGUGUACAACAAUA | 766 | UAUUGUUGUACACAGCAUUUAUU | 1150 |

TABLE 5A-continued

Nucleobase sequences of siRNAs used in in vitro screening‡

| Position | siRNA# | Sense (5'-3') | SEQ ID NO: | Antisense (5'-3') | SEQ ID NO |
|---|---|---|---|---|---|
| 2687 | siRNA375 | UGCUGUGUACAACAAUGCUUA | 767 | UAAGCAUUGUUGUACACAGCAUU | 1151 |
| 2690 | siRNA376 | UGUGUACAACAAUGCUUUGAA | 768 | UUCAAAGCAUUGUUGUACACAUU | 1152 |
| 2691 | siRNA377 | GUGUACAACAAUGCUUUGAUA | 769 | UAUCAAAGCAUUGUUGUACACUU | 1153 |
| 2692 | siRNA378 | UGUACAACAAUGCUUUGAUAA | 770 | UUAUCAAAGCAUUGUUGUACAUU | 1154 |
| 2833 | siRNA379 | GAUAAUUUUGAAAUGAUUCAA | 771 | UUGAAUCAUUUCAAAAUUAUCUU | 1155 |
| 2834 | siRNA380 | AUAAUUUUGAAAUGAUUCAUA | 772 | UAUGAAUCAUUUCAAAAUUAUUU | 1156 |
| 2835 | siRNA381 | UAAUUUUGAAAUGAUUCAUCA | 773 | UGAUGAAUCAUUUCAAAAUUAUU | 1157 |
| 2838 | siRNA382 | UUUUGAAAUGAUUCAUCUUUA | 774 | UAAAGAUGAAUCAUUUCAAAAUU | 1158 |
| 2839 | siRNA383 | UUUGAAAUGAUUCAUCUUUCA | 775 | UGAAAGAUGAAUCAUUUCAAAUU | 1159 |
| 2858 | siRNA384 | CAGAAAUAAAAGUAUGAAUCA | 776 | UGAUUCAUACUUUUAUUUCUGUU | 1160 |

‡Each uracil base (U) in any one of the sequences provided in Table 5A may independently and optionally be replaced with a thymine base (T).

TABLE 5B siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 34 | siRNA1-M0 | [mU][mU][mC][mU][mU][mC][mC][mU][C][A][G][A][G][mA][mU][mU][mU][mU][G][mG][mA] | 393 | 1191 | [mU][C][C][mA][A][A][A]U[C][U][mC][mU][G][A][G][mG][A][mA][G][A][mA][mU][mU] | 777 | 1605 |
| 40 | siRNA2-M0 | [mC][mU][mC][mA][mG][mA][mG][mA][U][U][U][U][G][mG][mC][mC][mU][mA][G][mA][mA] | 394 | 1192 | [mU][U][C][mU][A][G][G][C][C][A][mA][mA][A][U][C][mU][C][mU][G][A][mG][mU][mU] | 778 | 1606 |
| 41 | siRNA3-M0 | [mU][mC][mA][mG][mA][mG][mA][mU][U][U][U][G][G][mC][mC][mU][mA][mG][A][mU][mA] | 395 | 1193 | [mU][A][U][mC][U][A][G][G][C][C][mA][mA][A][A][U][mC][U][mC][U][G][mA][mU][mU] | 779 | 1607 |
| 42 | siRNA4-M0 | [mC][mA][mG][mA][mG][mG][mU][mU][U][U][G][G][C][mC][mU][mA][mG][mA][U][mU][mA] | 396 | 1194 | [mU][A][A][mU][C][U][A][G][G][C][mC][mA][A][A][A][mU][C][mU][C][U][mG][mU][mU] | 780 | 1608 |
| 43 | siRNA5-M0 | [mA][mG][mA][mG][mA][mU][mU][mU][U][G][G][C][C][mU][mA][mG][mA][mU][U][mU][mA] | 397 | 1195 | [mU][A][A][mA][U][U][U][A][G][G][mC][mC][A][A][A][mA][U][mC][U][C][mU][mU][mU] | 781 | 1609 |
| 45 | siRNA6-M0 | [mA][mG][mA][mU][mU][mU][mU][mG][G][C][C][U][A][mG][mA][mU][mU][mU][G][mC][mA] | 398 | 1196 | [mU][G][C][mA][A][A][U][C][U][A][mG][mG][C][C][A][mA][A][mA][U][C][mU][mU][mU] | 782 | 1610 |
| 105 | siRNA7-M0 | [mC][mA][mG][mC][mA][mU][mG][mC][U][G][U][U][G][mU][mC][mU][mA][mU][G][mG][mA] | 399 | 1197 | [mU][C][C][mA][U][A][G][A][C][A][mA][mC][A][G][C][mA][U][mG][C][U][mG][mU][mU] | 783 | 1611 |
| 110 | siRNA8-M0 | [mU][mG][mC][mU][mG][mU][mU][mG][U][C][U][A][U][mG][mG][mC][mU][mU][A][mU][mA] | 400 | 1198 | [mU][A][U][mA][A][G][C][C][A][U][mA][mG][A][C][A][mA][C][mA][G][C][mA][mU][mU] | 784 | 1612 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 111 | siRNA9-M0 | [mG][mC][mU][mG][mU][mU][mG][mU][C][U][A][U][G][mG][mC][mU][mU][mA][U][mU][mA] | 401 | 1199 | [mU][A][A][mU][A][A][G][C][C][A][mU][mA][G][A][C][mA][A][mC][A][G][mC][mU][mU] | 785 | 1613 |
| 112 | siRNA10-M0 | [mC][mU][mG][mU][mU][mG][mU][mC][U][A][U][G][G][mC][mU][mU][mA][mU][U][mC][mA] | 402 | 1200 | [mU][G][A][mA][U][A][A][G][C][C][mA][mU][A][G][A][mC][A][mA][C][A][mG][mU][mU] | 786 | 1614 |
| 113 | siRNA11-M0 | [mU][mG][mU][mU][mG][mU][mC][mU][A][U][G][G][C][mU][mU][mA][mU][mU][C][mU][mA] | 403 | 1201 | [mU][A][G][mA][A][U][A][A][G][C][mC][mA][U][A][G][mA][C][mA][A][C][mA][mU][mU] | 787 | 1615 |
| 115 | siRNA12-M0 | [mU][mU][mG][mU][mC][mU][mA][mU][G][G][C][U][U][mA][mU][mU][mC][mU][U][mG][mA] | 404 | 1203 | [mU][C][A][mA][G][A][A][U][A][A][mG][mC][C][A][G][mA][C][mA][A][C][mA][mU][mU] | 788 | 1616 |
| 116 | siRNA13-M0 | [mU][mG][mU][mC][mU][mA][mU][mG][G][C][U][U][A][mU][mU][mC][mU][mU][G][mG][mA] | 405 | 1204 | [mU][C][C][mA][A][G][A][A][U][A][mA][mG][C][C][A][mU][A][mG][A][C][mA][mU][mU] | 789 | 1617 |
| 117 | siRNA14-M0 | [mG][mU][mC][mU][mA][mU][mG][mG][C][U][U][A][U][mU][mC][mU][mU][mG][G][mA][mA] | 406 | 1205 | [mU][U][C][mC][A][A][G][A][A][U][mA][mA][G][C][C][mA][U][mA][G][A][mC][mU][mU] | 790 | 1618 |
| 118 | siRNA15-M0 | [mU][mC][mU][mA][mU][mG][mG][mC][U][U][A][U][U][mC][mU][mU][mG][mG][A][mA][mA] | 407 | 1206 | [mU][U][U][mC][C][A][A][G][A][A][mU][mA][A][G][C][mC][A][mU][A][G][mA][mU][mU] | 791 | 1619 |
| 139 | siRNA16-M0 | [mU][mA][mG][mG][mA][mG][mA][mA][G][G][C][A][A][mA][mC][mG][mG][mG][U][mG][mA] | 408 | 1207 | [mU][C][A][mC][C][C][G][U][U][U][mG][mC][C][U][U][U][mG][mC][C][mA][mU][mU] | 792 | 1620 |
| 141 | siRNA17-M0 | [mG][mG][mA][mG][mA][mA][mG][mG][C][A][A][A][C][mG][mG][mG][mU][mG][A][mA][mA] | 409 | 1208 | [mU][U][U][mC][A][C][C][C][G][U][mU][mU][G][C][C][mU][U][mC][U][C][mC][mU][mU] | 793 | 1621 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 142 | siRNA18-M0 | [mG][mA][mG][mA][mA][mG][mG][mC][A][A][A][C][G][mG][mG][mU][mG][mA][A][mC][mA] | 410 | 1209 | [mU][G][U][mU][C][A][C][C][C][G][mU][mU][U][G][C][mC][U][mU][C][U][mC][mU][mU] | 794 | 1622 |
| 143 | siRNA19-M0 | [mA][mG][mA][mA][mG][mG][mC][mA][A][A][C][G][G][mG][mU][mG][mA][mA][C][mC][mA] | 411 | 1210 | [mU][G][G][mU][U][C][A][C][C][C][mG][mU][U][U][G][mC][C][mU][U][C][mU][mU][mU | 795 | 1623 |
| 181 | siRNA20-M0 | [mA][mA][mU][mU][mC][mC][mA][mU][A][C][C][U][G][mG][mG][mC][mU][mG][U][mG][mA] | 412 | 1211 | [mU][C][A][mC][A][G][C][C][C][A][mG][mG][U][A][U][mG][G][mA][A][U][mU][mU][mU] | 796 | 1624 |
| 182 | siRNA21-M0 | [mA][mU][mU][mC][mC][mA][mU][mA][C][C][U][G][G][mG][mC][mU][mG][mU][G][mC][mA] | 413 | 1212 | [mU][G][C][mA][C][A][G][C][C][C][mA][mG][G][U][A][mU][G][mG][A][A][mU][mU][mU] | 797 | 1625 |
| 183 | siRNA22-M0 | [mU][mU][mC][mC][mA][mU][mA][mC][C][U][G][G][G][mC][mU][mG][mU][mG][C][mU][mA] | 414 | 1213 | [mU][A][G][mC][A][C][A][G][C][C][mC][mA][G][G][U][mA][U][mG][G][A][mA][mU][mU] | 798 | 1626 |
| 201 | siRNA23-M0 | [mC][mU][mC][mU][mG][mC][mA][mA][U][U][U][G][G][mU][mG][mC][mC][mA][A][mU][mA] | 415 | 1214 | [mU][A][U][mU][G][G][C][A][C][C][mA][mA][A][U][U][mG][C][mA][G][A][mG][mU][mU] | 799 | 1627 |
| 203 | siRNA24-M0 | [mC][mU][mG][mC][mA][mA][mU][mU][U][G][G][U][G][mC][mC][mA][mA][mU][C][mC][mA] | 416 | 1215 | [mU][G][G][mA][U][U][G][G][C][A][mC][mC][A][A][A][mU][U][mG][C][A][mG][mU][mU] | 800 | 1628 |
| 210 | siRNA25-M0 | [mU][mU][mG][mG][mU][mG][mC][mC][A][A][U][C][C][mU][mC][mU][mU][mG][A][mG][mA] | 417 | 1216 | [mU][C][U][mC][A][A][G][A][G][G][mA][mU][U][G][G][mC][A][mC][C][A][mA][mU][mU] | 801 | 1629 |
| 214 | siRNA26-M0 | [mU][mG][mC][mC][mA][mA][mU][mC][C][U][C][U][U][mG][mA][mG][mU][mU][C][mC][mA] | 418 | 1217 | [mU][G][G][mA][A][C][U][C][A][A][mG][mA][G][G][A][mU][U][mG][G][C][mA][mU][mU] | 802 | 1630 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 223 | siRNA27-M0 | [mU][mC][mU][mU][mG][mA][mG][mU][U][C][C][U][C][mA][mG][mA][mG][mC][A][mA][mA] | 419 | 1218 | [mU][U][U][mG][C][U][C][U][G][A][mG][mG][A][A][C][mU][C][mA][A][G][mA][mU][mU | 803 | 1631 |
| 225 | siRNA28-M0 | [mU][mU][mG][mA][mG][mU][mU][mC][C][U][C][A][G][mA][mG][mC][mA][mA][A][mU][mA] | 420 | 1220 | [mU][A][U][mU][U][G][C][U][C][U][mG][mA][G][G][A][mA][C][mU][C][A][mA][mU][mU] | 804 | 1632 |
| 229 | siRNA29-M0 | [mG][mU][mU][mC][mC][mU][mC][mA][G][A][G][C][A][mA][mA][mU][mC][mA][A][mA][mA] | 421 | 1221 | [mU][U][U][mU][G][A][U][U][U][G][mC][mU][C][U][G][mA][G][mG][A][A][mC][mU][mU] | 805 | 1633 |
| 230 | siRNA30-M0 | [mU][mU][mC][mC][mU][mC][mA][mG][A][G][C][A][A][mA][mU][mC][mA][mA][A][mG][mA] | 422 | 1222 | [mU][C][U][mU][U][G][A][U][U][U][mG][mC][U][C][U][mG][A][mG][G][A][mA][mU][mU] | 806 | 1634 |
| 236 | siRNA31-M0 | [mA][mG][mA][mG][mC][mA][mA][mA][U][C][A][A][A][mG][mG][mA][mA][mA][C][mA][mA] | 423 | 1223 | [mU][U][G][mU][U][U][C][C][U][U][mG][mG][A][U][U][mU][G][mC][U][C][mU][mU][mU] | 807 | 1635 |
| 238 | siRNA32-M0 | [mA][mG][mC][mA][mA][mA][mU][mC][A][A][A][G][G][mA][mA][mA][mC][mA][U][mG][mA] | 424 | 1224 | [mU][C][A][mU][G][U][U][U][C][C][mU][mU][U][G][A][mU][U][mU][G][C][mU][mU][mU] | 808 | 1636 |
| 242 | siRNA33-M0 | [mA][mA][mU][mC][mA][mA][mA][mG][G][A][A][A][C][mA][mU][mG][mG][mU][C][mA][mA] | 425 | 1225 | [mU][U][G][mA][C][C][A][U][G][U][mU][mU][C][C][U][mU][U][mG][A][U][mU][mU][mU] | 809 | 1637 |
| 243 | siRNA34-M0 | [mA][mU][mC][mA][mA][mA][mG][mG][A][A][A][C][A][mU][mG][mG][mU][mC][A][mU][mA] | 426 | 1226 | [mU][A][U][mG][A][C][C][A][U][G][mU][mU][U][C][C][mU][U][mU][G][A][mU][mU][mU | 810 | 1638 |
| 244 | siRNA35-M0 | [mU][mC][mA][mA][mA][mG][mG][mA][A][A][C][A][U][mG][mG][mU][mC][mA][U][mG][mA] | 427 | 1227 | [mU][C][A][mU][G][A][C][C][A][U][mG][mU][U][U][C][mC][U][mU][U][G][mA][mU][mU] | 811 | 1639 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 245 | siRNA36-M0 | [mC][mA][mA][mA][mG][mG][mA][mA][A][C][A][U][G][mG][mU][mC][mA][mU][G][mU][mA] | 428 | 1228 | [mU][A][C][mA][U][G][A][C][C][A][mU][mG][U][U][U][mC][C][mU][U][U][mG][mU][mU] | 812 | 1640 |
| 246 | siRNA37-M0 | [mA][mA][mA][mG][mG][mA][mA][mA][C][A][U][G][G][mU][mC][mA][mU][mG][U][mU][mA] | 429 | 1229 | [mU][A][A][mC][A][U][G][A][C][C][mA][mU][G][U][U][mU][C][mC][U][U][mU][mU][mU] | 813 | 1641 |
| 251 | siRNA38-M0 | [mA][mA][mA][mC][mA][mU][mG][mG][U][C][A][U][G][mU][mU][mU][mU][mU][A][mC][mA] | 430 | 1230 | [mU][G][U][mA][A][A][A][A][C][A][mU][mG][A][C][C][mA][U][mG][U][U][mU][mU][mU | 814 | 1642 |
| 253 | siRNA39-M0 | [mA][mC][mA][mU][mG][mG][mU][mC][A][U][G][U][U][mU][mU][mU][mA][mC][C][mU][mA] | 431 | 1232 | [mU][A][G][mG][U][A][A][A][A][A][mC][mA][U][G][A][mC][C][mA][U][G][mU][mU][mU] | 815 | 1643 |
| 254 | siRNA40-M0 | [mC][mA][mU][mG][mG][mU][mC][mA][U][G][U][U][U][mU][mU][mA][mC][mC][U][mG][mA] | 432 | 1233 | [mU][C][A][mG][G][U][A][A][A][A][mA][mC][A][U][G][mA][C][mC][A][U][mG][mU][mU] | 816 | 1644 |
| 262 | siRNA41-M0 | [mU][mG][mU][mU][mU][mU][mU][mA][C][C][U][G][C][mA][mA][mA][mC][mU][A][mA][mA] | 433 | 1234 | [mU][U][U][mA][G][U][U][U][G][C][mA][mG][G][U][A][mA][A][mA][A][C][mA][mU][mU] | 817 | 1645 |
| 264 | siRNA42-M0 | [mU][mU][mU][mU][mU][mA][mC][mC][U][G][C][A][A][mA][mC][mU][mA][mA][U][mG][mA] | 434 | 1235 | [mU][C][A][mU][U][A][G][U][U][U][mG][mC][A][G][G][mU][A][mA][A][A][mA][mU][mU] | 818 | 1646 |
| 266 | siRNA43-M0 | [mU][mU][mU][mA][mC][mC][mU][mG][C][A][A][A][C][mU][mA][mA][mU][mG][G][mG][mA] | 435 | 1236 | [mU][C][C][mC][A][U][U][A][G][U][mU][mU][G][C][A][mG][G][mU][A][A][mA][mU][mU] | 819 | 1647 |
| 267 | siRNA44-M0 | [mU][mU][mA][mC][mC][mU][mG][mC][A][A][A][C][U][mA][mA][mU][mG][mG][G][mA][mA] | 436 | 1237 | [mU][U][C][mC][C][A][U][U][A][G][mU][mU][U][G][C][mA][G][mG][U][A][mA][mU][mU] | 820 | 1648 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 268 | siRNA45-M0 | [mU][mA][mC][mC][mU][mG][mC][mA][A][A][C][U][A][mA][mU][mG][mG][mG][A][mA][mA] | 437 | 1238 | [mU][U][U][mC][C][C][A][U][U][A][mG][mU][U][U][G][mC][A][mG][G][U][mA][mU][mU] | 821 | 1649 |
| 291 | siRNA46-M0 | [mA][mU][mG][mU][mC][mC][mA][mU][U][U][C][A][U][mC][mA][mC][mA][mA][A][mU][mA] | 438 | 1239 | [mU][A][U][mU][U][G][U][G][A][U][mG][mA][A][A][U][mG][G][mA][C][A][mU][mU][mU] | 822 | 1650 |
| 292 | siRNA47-M0 | [mU][mG][mU][mC][mC][mA][mU][mU][U][C][A][U][C][mA][mC][mA][mA][mA][U][mC][mA] | 439 | 1240 | [mU][G][A][mU][U][U][G][U][G][A][mU][mG][A][A][A][mU][G][mG][A][C][mA][mU][mU] | 823 | 1651 |
| 294 | siRNA48-M0 | [mU][mC][mC][mA][mU][mU][mU][mC][A][U][C][A][C][mA][mA][mA][mU][mC][C][mC][mA] | 440 | 1242 | [mU][G][G][mG][A][U][U][U][G][U][mG][mA][U][G][A][mA][A][mU][G][G][mA][mU][mU] | 824 | 1652 |
| 300 | siRNA49-M0 | [mU][mC][mA][mU][mC][mA][mC][mA][A][A][U][C][C][mC][mU][mU][mG][mU][C][mA][mA] | 441 | 1243 | [mU][U][G][mA][C][A][A][G][G][G][mA][mU][U][U][G][mU][G][mA][U][G][mA][mU][mU] | 825 | 1653 |
| 302 | siRNA50-M0 | [mA][mU][mC][mA][mC][mA][mA][mA][U][C][C][C][U][mU][mG][mU][mC][mA][U][mA][mA] | 442 | 1244 | [mU][U][A][mU][G][A][C][A][A][G][mG][mG][A][U][U][mU][G][mU][G][A][mU][mU][mU] | 826 | 1654 |
| 303 | siRNA51-M0 | [mU][mC][mA][mC][mA][mA][mA][mU][C][C][C][U][U][mG][mU][mC][mA][mU][A][mC][mA] | 443 | 1245 | [mU][G][U][mA][U][G][A][C][A][A][mG][mG][G][A][U][mU][U][mG][U][G][mA][mU][mU] | 827 | 1655 |
| 304 | siRNA52-M0 | [mC][mA][mC][mA][mA][mA][mU][mC][C][C][U][U][G][mU][mC][mA][mU][mA][C][mC][mA] | 444 | 1247 | [mU][G][G][mU][A][U][G][A][C][A][mA][mG][G][G][A][mU][U][mU][G][U][mG][mU][mU] | 828 | 1656 |
| 305 | siRNA53-M0 | [mA][mC][mA][mA][mA][mU][mC][mC][C][U][U][G][U][mC][mA][mU][mA][mC][C][mA][mA] | 445 | 1248 | [mU][U][G][mG][U][A][U][G][A][C][mA][mA][G][G][G][mA][U][mU][U][G][mU][mU][mU] | 829 | 1657 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 309 | siRNA54-M0 | [mA][mU][mC][mC][mC][mU][mU][mG][U][C][A][U][A][mC][mC][mA][mU][mA][A][mG][mA] | 446 | 1249 | [mU][C][U][mU][A][U][G][G][U][A][mU][mG][A][C][A][mA][G][mG][G][A][mU][mU][mU] | 830 | 1658 |
| 310 | siRNA55-M0 | [mU][mC][mC][mC][mU][mU][mG][mU][C][A][U][A][C][mC][mA][mU][mA][mA][G][mG][mA] | 447 | 1250 | [mU][C][C][mU][U][A][U][G][G][U][mA][mU][G][A][C][mA][A][mG][G][G][mA][mU][mU] | 831 | 1659 |
| 311 | siRNA56-M0 | [mC][mC][mC][mU][mU][mG][mU][mC][A][U][A][C][C][mA][mU][mA][mA][mG][G][mU][mA] | 448 | 1251 | [mU][A][C][mC][U][U][A][U][G][G][mU][mA][U][G][A][mC][A][mA][G][G][mG][mU][mU] | 832 | 1660 |
| 312 | siRNA57-M0 | [mC][mC][mU][mU][mG][mU][mC][mA][U][A][C][C][A][mU][mA][mA][mG][mG][U][mG][mA] | 449 | 1252 | [mU][C][A][mC][C][U][U][A][U][G][mG][mU][A][U][G][mA][C][mA][A][G][mG][mU][mU] | 833 | 1661 |
| 313 | siRNA58-M0 | [mC][mU][mU][mG][mU][mC][mA][mU][A][C][C][A][U][mA][mA][mG][mG][mU][G][mU][mA] | 450 | 1253 | [mU][A][C][mA][C][C][U][U][A][U][mG][mG][U][A][U][mG][A][mC][A][A][mG][mU][mU] | 834 | 1662 |
| 315 | siRNA59-M0 | [mU][mG][mU][mC][mA][mU][mA][mC][C][A][U][A][A][mG][mG][mU][mG][mU][U][mG][mA] | 451 | 1254 | [mU][C][A][mA][C][A][C][C][U][U][mA][mU][G][G][U][mA][U][mG][A][C][mA][mU][mU] | 835 | 1663 |
| 319 | siRNA60-M0 | [mA][mU][mA][mC][mC][mA][mU][mA][A][G][G][U][G][mU][mU][mG][mU][mG][C][mC][mA] | 452 | 1255 | [mU][G][G][mC][A][C][A][A][C][A][mC][mC][U][U][A][mU][G][mG][U][A][mU][mU][mU] | 836 | 1664 |
| 360 | siRNA61-M0 | [mA][mA][mA][mA][mA][mU][mU][mU][C][A][C][U][U][mU][mG][mC][mU][mA][C][mU][mA] | 453 | 1256 | [mU][A][G][mU][A][G][C][A][A][A][mG][mU][G][A][A][mA][U][mU][U][U][mU][mU][mU] | 837 | 1665 |
| 363 | siRNA62-M0 | [mA][mA][mU][mU][mU][mC][mA][mC][U][U][U][G][C][mU][mA][mC][mU][mU][C][mU][mA] | 454 | 1257 | [mU][A][G][mA][A][G][U][A][G][C][mA][mA][A][G][U][mG][A][mA][A][U][mU][mU][mU] | 838 | 1666 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 372 | siRNA63-M0 | [mU][m][mG][mC][mU][mA][mC][mU][U][C][U][G][C][mG][mA][mA][mG][mG][C][mA][mA] | 455 | 1258 | [mU][U][G][mC][C][U][U][C][G][C][mA][mG][A][A][G][mU][A][mG][C][A][mA][mU][mU] | 839 | 1667 |
| 375 | siRNA64-M0 | [mC][mU][mA][mC][mU][mU][mC][mU][G][C][G][A][A][mG][mG][mC][mA][mU][U][mU][mA] | 456 | 1259 | [mU][A][A][mA][U][G][C][C][U][U][mC][mG][C][A][G][mA][A][mG][U][A][mG][mU][mU] | 840 | 1668 |
| 377 | siRNA65-M0 | [mA][mC][mU][mU][mC][mU][mG][mC][G][A][A][G][G][mC][mA][mU][mU][mU][G][mG][mA] | 457 | 1260 | [mU][C][C][mA][A][A][U][G][C][C][mU][mU][C][G][C][mA][G][mA][A][G][mU][mU][mU] | 841 | 1669 |
| 390 | siRNA66-M0 | [mC][mA][mU][mU][mU][mG][mG][mG][C][A][C][A][G][mA][mA][mG][mC][mA][U][mU][mA] | 458 | 1261 | [mU][A][A][mU][G][C][U][U][C][U][mG][mU][G][C][C][mC][A][mA][A][U][mG][mU][mU] | 842 | 1670 |
| 392 | siRNA67-M0 | [mU][mU][mU][mG][mG][mG][mC][mA][C][A][G][A][A][mG][mC][mA][mU][mU][G][mA][mA] | 459 | 1262 | [mU][U][C][mA][A][U][G][C][U][U][mC][mU][G][U][G][mC][C][mC][A][A][mA][mU][mU] | 843 | 1671 |
| 394 | siRNA68-M0 | [mU][mG][mG][mG][mC][mA][mC][mA][G][A][A][G][C][mA][mU][mU][mG][mA][C][mC][mA] | 460 | 1263 | [mU][G][G][mU][C][A][A][U][G][C][mU][mU][C][U][G][mU][G][mC][C][C][mA][mU][mU] | 844 | 1672 |
| 474 | siRNA69-M0 | [mA][mU][mG][mC][mC][mU][mU][mG][A][A][U][U][C][mC][mC][mU][mC][mA][C][mG][mA] | 461 | 1264 | [mU][C][G][mU][G][A][G][G][G][A][mA][mU][U][C][A][mA][G][mG][C][A][mU][mU][mU] | 845 | 1673 |
| 475 | siRNA70-M0 | [mU][mG][mC][mC][mU][mU][mG][mA][A][U][U][C][C][mC][mU][mC][mA][mC][G][mG][mA] | 462 | 1265 | [mU][C][C][mG][U][G][A][G][G][G][mA][mA][U][U][C][mA][A][mG][G][C][mA][mU][mU] | 846 | 1674 |
| 476 | siRNA71-M0 | [mG][mC][mC][mU][mU][mG][mA][mA][U][U][C][C][C][mU][mC][mA][mC][mG][G][mA][mA] | 463 | 1266 | [mU][U][C][mC][G][U][G][A][G][G][mG][mA][A][U][U][mC][A][mA][G][G][mC][mU][mU] | 847 | 1675 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 477 | siRNA72-M0 | [mC][mC][mU][mU][mG][mA][mA][mU][U][C][C][C][U][mC][mA][mC][mG][mG][A][mA][mA] | 464 | 1268 | [mU][U][U][mC][C][G][U][G][A][G][mG][mG][A][A][U][mU][C][mA][A][G][mG][mU][mU] | 848 | 1676 |
| 478 | siRNA73-M0 | [mC][mU][mU][mG][mA][mA][mU][mU][C][C][C][U][C][mA][mC][mG][mG][mA][A][mA][mA] | 465 | 1269 | [mU][U][U][mU][C][C][G][U][G][A][mG][mG][G][A][A][mU][U][mC][A][A][mG][mU][mU] | 849 | 1677 |
| 482 | siRNA74-M0 | [mA][mA][mU][mU][mC][mC][mC][mU][C][A][C][G][G][mA][mA][mA][mG][mC][A][mU][mA] | 466 | 1271 | [mU][A][U][mG][C][U][U][U][C][C][mG][mU][G][A][G][mG][G][mA][A][U][mU][mU][mU] | 850 | 1678 |
| 484 | siRNA75-M0 | [mU][mU][mC][mC][mC][mU][mC][mA][C][G][G][A][A][mA][mG][mC][mA][mU][G][mA][mA] | 467 | 1272 | [mU][U][C][mA][U][G][C][U][U][U][mC][mC][G][U][G][mA][G][mG][G][A][mA][mU][mU] | 851 | 1679 |
| 486 | siRNA76-M0 | [mC][mC][mC][mU][mC][mA][mC][mG][G][A][A][A][G][mC][mA][mU][mG][mA][U][mG][mA] | 468 | 1273 | [mU][C][A][mU][C][A][U][G][C][U][mU][mU][C][C][G][mU][G][mA][G][G][mG][mU][mU] | 852 | 1680 |
| 488 | siRNA77-M0 | [mC][mU][mC][mA][mC][mG][mG][mA][A][A][G][C][A][mU][mG][mA][mU][mG][G][mA][mA] | 469 | 1274 | [mU][U][C][mC][A][U][C][A][U][G][mC][mU][U][U][C][mC][G][mU][G][A][mG][mU][mU] | 853 | 1681 |
| 501 | siRNA78-M0 | [mU][mG][mA][mU][mG][mG][mA][mA][A][A][C][C][U][mC][mC][mA][mA][mC][G][mU][mA] | 470 | 1275 | [mU][A][C][mG][U][U][G][G][A][G][mG][mU][U][U][U][mC][C][mA][U][C][mA][mU][mU] | 854 | 1682 |
| 503 | siRNA79-M0 | [mA][mU][mG][mG][mA][mA][mA][mA][C][C][U][C][C][mA][mA][mC][mG][mU][A][mU][mA] | 471 | 1276 | [mU][A][U][mA][C][G][U][U][G][G][mA][mG][G][U][U][mU][U][mC][C][A][mU][mU][mU] | 855 | 1683 |
| 505 | siRNA80-M0 | [mG][mG][mA][mA][mA][mA][mC][mC][U][C][C][A][A][mC][mG][mU][mA][mU][C][mA][mA] | 472 | 1277 | [mU][U][G][mA][U][A][C][G][U][U][mG][mG][A][G][G][mU][U][mU][U][C][mC][mU][mU] | 856 | 1684 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 506 | siRNA81-M0 | [mG][mA][mA][mA][mA][mC][mC][mU][C][C][A][A][C][mG][mU][mA][mU][mC][A][mU][mA] | 473 | 1278 | [mU][A][U][mG][A][U][A][C][G][U][mU][mG][G][A][G][mG][U][mU][U][U][mC][mU][mU] | 857 | 1685 |
| 507 | siRNA82-M0 | [mA][mA][mA][mA][mC][mC][mU][mC][C][A][A][C][G][mU][mA][mU][mC][mA][U][mG][mA] | 474 | 1280 | [mU][C][A][mU][G][A][U][A][C][G][mU][mU][G][G][A][mG][G][mU][U][U][mU][mU][mU] | 858 | 1686 |
| 509 | siRNA83-M0 | [mA][mA][mC][mC][mU][mC][mC][mA][A][C][G][U][A][m][mC][mA][mU][mG][A][mG][mA] | 475 | 1281 | [mU][C][U][mC][A][U][G][A][U][A][mC][mG][U][U][G][mG][A][mG][G][U][mU][mU][mU] | 859 | 1687 |
| 510 | siRNA84-M0 | [mA][mC][mC][mU][mC][mC][mA][mA][C][G][U][A][U][mC][mA][mU][mG][mA][G][mA][mA] | 476 | 1282 | [mU][U][C][mU][C][A][U][G][A][U][mA][mC][G][U][U][mG][G][mA][G][G][mU][mU][mU] | 860 | 1688 |
| 511 | siRNA85-M0 | [mC][mC][mU][mC][mC][mA][mA][mC][G][U][A][U][C][mA][mU][mG][mA][mG][A][mC][mA] | 477 | 1283 | [mU][G][U][mC][U][C][A][U][G][A][mU][mA][C][G][U][mU][G][mG][A][G][mG][mU][mU] | 861 | 1689 |
| 512 | siRNA86-M0 | [mC][mU][mC][mC][mA][mA][mC][mG][U][A][U][C][A][mU][mG][mA][mG][mA][C][mC][mA] | 478 | 1284 | [mU][G][G][mU][C][U][C][A][U][G][mA][mU][A][C][G][mU][U][mG][G][A][mG][mU][mU] | 862 | 1690 |
| 513 | siRNA87-M0 | [mU][mC][mC][mA][mA][mC][mG][mU][A][U][C][A][U][mG][mA][mG][mA][mC][C][mU][mA] | 479 | 1285 | [mU][A][G][mG][U][C][U][C][A][U][mG][mA][U][A][C][mG][U][mU][G][G][mA][mU][mU] | 863 | 1691 |
| 514 | siRNA88-M0 | [mC][mC][mA][mA][mC][mG][mU][mA][U][C][A][U][G][mA][mG][mA][mC][mC][U][mC][mA] | 480 | 1286 | [mU][G][A][mG][G][U][C][U][C][A][mU][mG][A][U][A][mC][G][mU][U][G][mG][mU][mU] | 864 | 1692 |
| 539 | siRNA89-M0 | [m][mC][mC][mU][mC][mU][mA][mA][C][U][C][A][A][mA][mG][mA][mC][mC][G][mC][mA] | 481 | 1287 | [mU][G][C][G][G][U][C][U][U][U][mH][mS][H][U][U][mA][G][mA][G][G][mA][mU][mU] | 865 | 1693 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 552 | siRNA90-M0 | [mA][mG][mA][mC][mC][mG][mC][mU][G][C][C][U][G][mG][mG][mU][mG][mA][C][mA][mA] | 482 | 1288 | [mU][U][G][mU][C][A][C][C][C][A][mG][mG][C][A][G][mC][G][mG][U][C][mU][mU][mU] | 866 | 1694 |
| 562 | siRNA91-M0 | [mC][mU][mG][mG][mG][mU][mG][mA][C][A][G][A][A][mG][mG][mG][mA][mU][G][mU][mA] | 483 | 1289 | [mU][A][C][mA][U][C][C][C][U][U][mC][mU][G][U][C][mA][C][mC][C][A][mG][mU][mU] | 867 | 1695 |
| 563 | siRNA92-M0 | [mU][mG][mG][mG][mU][mG][mA][mC][A][G][A][A][G][mG][mG][mA][mU][mG][U][mA][mA] | 484 | 1290 | [mU][U][A][mC][A][U][C][C][C][U][mU][mC][U][G][U][mC][A][mC][C][C][mA][mU][mU] | 868 | 1696 |
| 564 | siRNA93-M0 | [mG][mG][mG][mU][mG][mA][mC][mA][G][A][A][G][G][mG][mA][mU][mG][mU][A][mU][mA] | 485 | 1291 | [mU][A][U][mA][C][A][U][C][C][C][mU][mU][C][U][G][mU][C][mA][C][C][mC][mU][mU] | 869 | 1697 |
| 585 | siRNA94-M0 | [mC][mU][mU][mU][mC][mU][mG][mC][U][A][C][C][G][mA][mG][mU][mG][mA][U][mG][mA] | 486 | 1292 | [mU][C][A][mU][C][A][C][U][C][G][mG][mU][A][G][C][mA][G][mA][A][A][mG][mU][mU] | 870 | 1698 |
| 587 | siRNA95-M0 | [mU][mU][mC][mU][mG][mC][mU][mA][C][C][G][A][G][mU][mG][mA][mU][mG][U][mU][mA] | 487 | 1293 | [mU][A][A][mC][A][U][C][A][C][U][mC][mG][G][U][A][mG][C][mA][G][A][mA][mU][mU] | 871 | 1699 |
| 588 | siRNA96-M0 | [mU][mC][mU][mG][mC][mU][mA][mC][C][G][A][G][U][mG][mA][mU][mG][mU][U][mU][mA] | 488 | 1294 | [mU][A][A][mA][C][A][U][C][A][C][mU][mC][G][G][U][mA][G][mC][A][G][mA][mU][mU] | 872 | 1700 |
| 589 | siRNA97-M0 | [mC][mU][mG][mC][mU][mA][mC][mC][G][A][G][U][G][mA][mU][mG][mU][mU][U][mG][mA] | 489 | 1295 | [mU][C][A][mA][A][C][A][U][C][A][mC][mU][C][G][G][mU][A][mG][C][A][mG][mU][mU] | 873 | 1701 |
| 593 | siRNA98-M0 | [mU][mA][mC][mC][mG][mA][mG][mU][G][A][U][G][U][mU][mU][mG][mA][mA][G][mC][mA] | 490 | 1296 | [mU][G][C][mU][U][C][A][A][A][C][mA][mU][C][A][C][mU][C][mG][G][U][mA][mU][mU] | 874 | 1702 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 594 | siRNA99-M0 | [mA][mC][mC][mG][mA][mG][mU][mG][A][U][G][U][U][mU][mG][mA][mA][mG][C][mU][mA] | 491 | 1297 | [mU][A][G][mC][U][U][C][A][A][A][mC][mA][U][C][A][mC][U][mC][G][G][mU][mU][mU] | 875 | 1703 |
| 595 | siRNA100-M0 | [mC][mC][mG][mA][mG][mU][mG][mA][U][G][U][U][U][mG][mA][mA][mG][mC][U][mG][mA] | 492 | 1298 | [mU][C][A][mG][C][U][U][C][A][A][mA][mC][A][U][C][mA][C][mU][C][G][mG][mU][mU] | 876 | 1704 |
| 602 | siRNA101-M0 | [mA][mU][mG][mU][mU][mU][mG][mA][A][G][C][U][G][mG][mG][mU][mA][mU][U][mU][mA] | 493 | 1300 | [mU][A][A][mA][U][A][C][C][C][A][mG][mC][U][U][C][mA][A][mA][C][A][mU][mU][mU] | 877 | 1705 |
| 605 | siRNA102-M0 | [mU][mU][mU][mG][mA][mA][mG][mC][U][G][G][G][U][mA][mU][mU][mU][mA][A][mC][mA] | 494 | 1302 | [mU][G][U][mU][A][A][A][U][A][C][mC][mC][A][G][C][mU][U][mC][A][A][mA][mU][mU] | 878 | 1706 |
| 606 | siRNA103-M0 | [mU][mU][mG][mA][mA][mG][mC][mU][G][G][G][U][A][mU][mU][mU][mA][mA][C][mU][mA] | 495 | 1303 | [mU][A][G][mU][U][A][A][A][U][A][mC][mC][C][A][G][mC][U][mU][C][A][mA][mU][mU] | 879 | 1707 |
| 607 | siRNA104-M0 | [mU][mG][mA][mA][mG][mC][mU][mG][G][G][U][A][U][mU][mU][mA][mA][mC][U][mA][mA] | 496 | 1304 | [mU][U][A][mG][U][U][A][A][A][U][mA][mC][C][C][A][mG][C][mU][U][C][mA][mU][mU] | 880 | 1708 |
| 608 | siRNA105-M0 | [mG][mA][mA][mG][mC][mU][mG][mG][G][U][A][U][U][mU][mA][mA][mC][mU][A][mU][mA] | 497 | 1305 | [mU][A][U][mA][G][U][U][A][A][A][mU][mA][C][C][C][mA][G][mC][U][U][mC][mU][mU] | 881 | 1709 |
| 609 | siRNA106-M0 | [mA][mA][mG][mC][mU][m][mA][mA][mC][mU][mA][U][mA][mA][mC][mU][mA][U][mC][mA] | 498 | 1306 | [mU][G][A][mU][A][G][U][U][A][A][mA][mU][A][C][C][mC][A][mG][C][U][mU][mU][mU] | 882 | 1710 |
| 610 | siRNA107-M0 | [mA][mG][mC][mU][mG][mG][mG][mU][A][U][U][U][A][mA][mC][mU][mA][mU][C][mU][mA] | 499 | 1307 | [mU][A][G][mA][U][A][G][U][U][A][mA][mA][U][A][C][mC][C][mA][G][C][mU][mU][mU] | 883 | 1711 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 612 | siRNA108-M0 | [mC][mU][mG][mG][mG][mU][mA][mU][U][U][A][A][C][mU][mA][mU][mC][mU][U][mU][mA] | 500 | 1308 | [mU][A][A][mA][G][A][U][A][G][U][mU][mA][A][A][U][mA][C][mC][C][A][mG][mU][mU | 884 | 1712 |
| 613 | siRNA109-M0 | [mU][mG][mG][mG][mU][mA][mU][mU][U][A][A][C][U][mA][mU][mC][mU][mU][U][mG][mA] | 501 | 1309 | [mU][C][A][mA][A][G][A][U][A][G][mU][mU][A][A][U][mA][C][mC][C][A][mA][mU][mU] | 885 | 1713 |
| 653 | siRNA110-M0 | [mG][mA][mC][mA][mC][mA][mC][mA][G][A][A][G][mC][mA][mC][mA][mU][A][mU][mA] | 502 | 1310 | [mU][A][U][mA][U][G][U][G][C][U][mU][mU][C][U][G][mU][G][mU][G][U][mC][mU][mU] | 886 | 1714 |
| 663 | siRNA111-M0 | [mA][mA][mG][mC][mA][mC][mA][mU][A][U][U][C][U][mA][mA][mA][mC][mA][A][mU][mA] | 503 | 1311 | [mU][A][U][mU][G][U][U][U][A][G][mA][mA][U][A][U][mG][U][mG][C][U][mU][mU][mU] | 887 | 1715 |
| 665 | siRNA112-M0 | [mG][mC][mA][mC][mA][mU][mA][mU][U][C][U][A][A][mA][mC][mA][mA][mU][C][mU][mA] | 504 | 1312 | [mU][A][G][m][U][U][G][U][U][U][mA][mG][A][A][U][mA][U][mG][U][G][mC][mU][mU] | 888 | 1716 |
| 666 | siRNA113-M0 | [mC][mA][mC][mA][mU][mA][mU][mU][C][U][A][A][A][mC][mA][mA][mU][mC][U][mU][mA] | 505 | 1313 | [mU][A][A][mG][A][U][U][G][U][U][mU][mA][G][A][A][mU][A][mU][G][U][mG][mU][mU] | 889 | 1717 |
| 667 | siRNA114-M0 | [mA][mC][mA][mU][mA][mU][mU][mC][U][A][A][A][C][mA][mA][mU][mC][mU][U][mG][mA] | 506 | 1314 | [mU][C][A][mA][G][A][U][U][G][U][mU][mU][A][G][A][mA][U][mA][U][G][mU][mU][mU] | 890 | 1718 |
| 669 | siRNA115-M0 | [mA][mU][mA][mU][mU][mC][mU][mA][A][A][C][A][A][mU][mC][mU][mU][mG][A][mC][mA] | 507 | 1315 | [mU][G][U][mC][A][A][G][A][U][U][mG][mU][U][U][A][mG][A][mA][U][A][mU][mU][mU] | 891 | 1719 |
| 670 | siRNA116-M0 | [mU][mA][mU][mU][mC][mU][mA][mA][A][C][A][A][U][mC][mU][mU][mG][mA][C][mA][mA] | 508 | 1316 | [mU][U][G][mU][C][A][A][G][A][U][mU][mG][U][U][U][mA][G][mA][A][U][mA][mU][mU] | 892 | 1720 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 671 | siRNA117-M0 | [mA][mU][mU][mC][mU][mA][mA][mA][C][A][A][U][C][mU][mU][mG][mA][mC][A][mA][mA] | 509 | 1317 | [mU][U][U][mG][U][C][A][A][G][A][mU][mU][U][U][U][mU][A][mG][A][A][mU][mU][mU] | 893 | 1721 |
| 673 | siRNA118-M0 | [mU][mC][mU][mA][mA][mA][mC][mA][A][U][C][U][U][mG][mA][mC][mA][mA][C][mU][mA] | 510 | 1318 | [mU][A][G][mU][U][G][U][C][A][A][mG][mA][U][U][G][mU][U][mU][A][G][mA][mU][mU] | 894 | 1722 |
| 679 | siRNA119-M0 | [mC][mA][mA][mU][mC][mU][mU][mG][A][C][A][A][C][mU][mU][mC][mA][mA][G][mC][mA] | 511 | 1320 | [mU][G][C][mU][U][G][A][A][G][U][mU][mG][U][C][A][mA][G][mA][U][U][mG][mU][mU] | 895 | 1723 |
| 712 | siRNA120-M0 | [mC][m][mU][mU][mC][mC][mA][mG][C][C][C][U][G][mG][mU][mA][mG][mC][A][mG][mA] | 512 | 1321 | [mU][C][U][mG][C][U][A][C][C][A][mG][mG][G][C][U][mG][G][mA][A][A][mG][mU][mU] | 896 | 1724 |
| 771 | siRNA121-M0 | [mG][mG][mG][mA][mG][mA][mA][mA][C][U][G][G][C][mA][mG][mA][mG][mA][G][mC][mA] | 513 | 1322 | [mU][G][C][mU][C][U][C][U][G][C][mC][mA][G][U][U][mU][C][mU][C][C][mC][mU][mU] | 897 | 1725 |
| 781 | siRNA122-M0 | [mG][mG][mC][mA][mG][mA][mG][mA][G][C][U][U][G][mA][mG][mG][mC][mA][C][mG][mA] | 514 | 1323 | [mU][C][G][mU][G][C][C][U][C][A][mA][mG][C][U][C][mU][C][mU][G][C][mC][mU][mU] | 898 | 1726 |
| 788 | siRNA123-M0 | [mA][mG][mC][mU][mU][mG][mA][mG][G][C][A][C][G][mA][mG][mA][mA][mC][C][mU][mA] | 515 | 1325 | [mU][A][G][mG][U][U][C][U][C][G][mU][mG][C][C][U][mC][A][mA][G][C][mU][mU][mU] | 899 | 1727 |
| 841 | siRNA124-M0 | [mC][mC][mU][mG][mC][mG][mC][mA][U][G][U][U][U][mC][mU][mC][mA][mA][U][mG][mA] | 516 | 1326 | [mU][C][A][mU][U][G][A][G][A][A][mA][mC][A][U][G][mC][G][mC][A][G][mG][mU][mU] | 900 | 1728 |
| 844 | siRNA125-M0 | [mG][mC][mG][mC][mA][mU][mG][mU][U][U][C][U][C][mA][mA][mU][mG][mA][C][mA][mA] | 517 | 1328 | [mU][U][G][mU][C][A][U][U][G][A][mG][mA][A][A][C][mA][U][mG][C][G][mC][mU][mU] | 901 | 1729 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 846 | siRNA126-M0 | [mG][mC][mA][mU][mG][mU][mU][mU][C][U][C][A][A][mU][mG][mA][mC][mA][C][mU][mA] | 518 | 1330 | [mU][A][G][mU][G][U][C][A][U][U][mG][mA][G][A][A][mA][C][mA][U][G][mC][mU][mU] | 902 | 1730 |
| 850 | siRNA127-M0 | [mG][mU][mU][mU][mC][mU][mC][mA][A][U][G][A][C][mA][mC][mU][mU][mU][G][mU][mA] | 519 | 1331 | [mU][A][C][mA][A][A][G][U][G][U][mC][mA][U][U][G][mA][G][mA][A][A][mC][mU][mU] | 903 | 1731 |
| 851 | siRNA128-M0 | [mU][mU][mU][mC][mU][mC][mA][mA][U][G][A][C][A][mC][mU][mU][mU][mG][U][mC][mA] | 520 | 1332 | [mU][G][A][mC][A][A][A][G][U][G][mU][mC][A][U][U][mG][A][mG][A][A][mA][mU][mU] | 904 | 1732 |
| 852 | siRNA129-M0 | [mU][mU][mC][mU][mC][mA][mA][mU][G][A][C][A][C][mU][mU][mU][mG][mU][C][mC][mA] | 521 | 1333 | [mU][G][G][mA][C][A][A][A][G][U][mG][mU][C][A][U][mU][G][mA][G][A][mA][mU][mU] | 905 | 1733 |
| 861 | siRNA130-M0 | [mA][mC][mA][mC][mU][mU][mU][mG][U][C][C][A][C][mC][mU][mU][mU][mG][A][mU][mA] | 522 | 1334 | [mU][A][U][mC][A][A][A][G][G][U][mG][mG][A][C][A][mA][A][mG][U][G][mU][mU][mU] | 906 | 1734 |
| 862 | siRNA131-M0 | [mC][mA][mC][mU][mU][mU][mG][mU][C][C][A][C][C][mU][mU][mU][mG][mA][U][mG][mA] | 523 | 1335 | [mU][C][A][mU][C][A][A][A][G][G][mU][mG][G][A][C][mA][A][mA][G][U][mG][mU][mU] | 907 | 1735 |
| 901 | siRNA132-M0 | [mA][mC][mA][mC][mC][mU][mC][mG][U][G][G][U][C][mC][mU][mC][mU][mG][G][mG][mA] | 524 | 1336 | [mU][C][C][mC][A][G][A][G][G][A][mC][mC][A][C][G][mA][G][mG][U][G][mU][mU][mU] | 908 | 1736 |
| 903 | siRNA133-M0 | [mA][mC][mC][mU][mC][mG][mU][mG][G][U][C][C][U][mC][mU][mG][mG][mG][C][mA][mA] | 525 | 1337 | [mU][U][G][mC][C][C][A][G][A][G][mG][mA][C][C][A][mC][G][mA][G][G][mU][mU][mU] | 909 | 1737 |
| 904 | siRNA134-M0 | [mC][mC][m][mC][mG][mU][mG][mG][U][C][C][U][C][mU][mG][mG][mG][mC][A][mU][mA] | 526 | 1338 | [mU][A][U][mG][C][C][C][A][G][A][mG][mG][A][C][C][mA][C][mG][A][G][mG][mU][mU] | 910 | 1738 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 905 | siRNA135-M0 | [mC][mU][mC][mG][mU][mG][mU][mU][C][C][U][C][U][mG][mG][mG][mC][mA][U][mC][mA] | 527 | 1339 | [mU][G][A][mU][G][C][C][C][A][G][mA][mG][G][A][C][mC][A][mC][G][A][mG][mU][mU] | 911 | 1739 |
| 906 | siRNA136-M0 | [[mU][mC][mG][mU][mG][mG][mU][mC][C][U][C][U][G][mG][mG][mC][mA][mU][C][mG][mA] | 528 | 1340 | [mU][C][G][mA][U][G][C][C][C][A][mG][mA][G][G][A][mC][C][mA][C][G][mA][mU][mU] | 912 | 1740 |
| 912 | siRNA137-M0 | [mU][mC][mC][mU][mC][mU][mG][mG][G][C][A][U][C][mG][mC][mA][mA][mG][C][mA][mA] | 529 | 1341 | [mU][U][G][mC][U][U][G][C][G][A][mU][mG][C][C][C][mA][G][mA][G][G][mA][mU][mU] | 913 | 1741 |
| 915 | siRNA138-M0 | [mU][mC][mU][mG][mG][mG][mC][mA][U][C][G][C][A][mA][mG][mC][mA][mA][A][mC][mA] | 530 | 1342 | [mU][G][U][mU][U][G][C][U][U][G][mC][mG][A][U][G][mC][C][mC][A][G][mA][mU][mU] | 914 | 1742 |
| 916 | siRNA139-M0 | [mC][mU][mG][mG][mG][mC][mA][mU][C][G][C][A][A][mG][mC][mA][mA][mA][C][mA][mA] | 531 | 1343 | [mU][U][G][mU][U][U][G][C][U][U][mG][mC][G][A][U][mG][C][mC][C][A][mG][mU][mU] | 915 | 1743 |
| 917 | siRNA140-M0 | [mU][mG][mG][mG][mC][mA][mU][mV][G][C][A][A][G][mC][mA][mA][mA][mC][A][mC][mA] | 532 | 1344 | [mU][G][U][mG][U][U][U][G][C][U][mU][mG][C][G][C][U][mU][mG][C][mA][mU][mU] | 916 | 1744 |
| 920 | siRNA141-M0 | [mG][mC][mA][mU][mC][mG][mC][mA][A][G][C][A][A][mA][mC][mA][mC][mC][A][mU][mA] | 533 | 1345 | [mU][A][U][mG][G][U][G][U][U][U][mG][mC][U][U][G][mC][G][mA][U][G][mC][mU][mU] | 917 | 1745 |
| 921 | siRNA142-M0 | [mC][mA][mU][mC][mG][mC][mA][mA][G][C][A][A][A][mC][mA][mC][mC][mA][U][mU][mA] | 534 | 1346 | [mU][A][A][mU][G][G][U][G][U][U][mU][mG][C][U][U][mG][C][mG][A][U][mG][mU][mU] | 918 | 1746 |
| 950 | siRNA143-M0 | [mU][mU][mC][mU][mG][mG][mA][mG][U][U][U][A][U][mU][mU][mC][mA][mA][A][mU][mA] | 535 | 1347 | [mU][A][U][mU][U][G][A][A][A][U][mA][mA][A][C][U][mC][C][mA][G][A][mA][mU][mU] | 919 | 1747 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 954 | siRNA144-M0 | [mG][mG][mA][mG][mU][mU][mU][mA][U][U][U][C][A][mA][mA][mU][mG][mA][U][mU][mA] | 536 | 1348 | [mU][A][A][mU][C][A][U][U][U][G][mA][mA][A][U][A][mA][A][mC][U][C][mC][mU][mU] | 920 | 1748 |
| 955 | siRNA145-M0 | [mG][mA][mG][mU][mU][mU][mA][mU][U][U][C][A][A][mA][mU][mG][mA][mU][U][mA][mA] | 537 | 1349 | [mU][U][A][mA][U][C][A][U][U][U][mG][mA][A][A][U][mA][A][mA][C][U][mC][mU][mU] | 921 | 1749 |
| 956 | siRNA146-M0 | [mA][mG][mU][mU][mU][mA][mU][mU][U][C][A][A][A][mU][mG][mA][mU][mU][A][mG][mA] | 538 | 1350 | [mU][C][U][mA][A][U][C][A][U][U][mU][mG][A][A][A][mU][A][mA][A][C][mU][mU][mU] | 922 | 1750 |
| 957 | siRNA147-M0 | [mG][mU][mU][mU][mA][mU][mU][mU][C][A][A][A][U][mG][mA][mU][mU][mA][G][mG][mA] | 539 | 1351 | [mU][C][C][mU][A][A][U][C][A][U][mU][mU][G][A][A][mA][U][mA][A][A][mC][mU][mU] | 923 | 1751 |
| 980 | siRNA148-M0 | [mC][mC][mA][mG][mA][mA][mG][mC][A][A][U][G][A][mA][mA][mG][mC][mA][G][mC][mA] | 540 | 1352 | [mU][G][C][mU][G][C][U][U][U][C][mA][mU][U][C][C][mU][U][mC][U][G][mG][mU][mU] | 924 | 1752 |
| 982 | siRNA149-M0 | [mA][mG][mA][mA][mG][mC][mA][mA][U][G][A][A][A][mG][mC][mA][mG][mC][U][mA][mA] | 541 | 1353 | [mU][U][A][mG][C][U][G][C][U][U][mU][mC][A][U][U][G][C][mU][U][C][mU][mU][mU] | 925 | 1753 |
| 983 | siRNA150-M0 | [mG][mA][mA][mG][mC][mA][mA][mU][G][A][A][A][G][mC][mA][mG][mC][mU][A][mC][mA] | 542 | 1354 | [mU][G][U][mA][G][C][U][G][C][U][mU][mU][C][A][U][mU][G][mC][U][U][mC][mU][mU] | 926 | 1754 |
| 988 | siRNA151-M0 | [mA][mA][mU][mG][mA][mA][mA][mG][C][A][G][C][U][mA][mC][mU][mG][mA][A][mG][mA] | 543 | 1355 | [mU][C][U][mU][C][A][G][U][A][G][mC][mU][G][C][U][mU][U][mC][A][U][mU][mU][mU] | 927 | 1755 |
| 989 | siRNA152-M0 | [mA][mU][mG][mA][mA][mA][mG][mC][A][G][C][U][A][mC][mU][mG][mA][mA][G][mA][mA] | 544 | 1356 | [mU][U][C][mU][U][C][A][G][U][A][mG][mC][U][G][C][mU][U][mU][C][A][mU][mU][mU] | 928 | 1756 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 992 | siRNA153-M0 | [mA][mA][mA][mG][mC][mA][mG][mC][U][A][C][U][G][mA][mA][mG][mA][mA][G][mU][mA] | 545 | 1357 | [mU][A][C][mU][U][C][U][U][C][A][mG][mU][A][G][C][mU][G][mC][U][U][mU][mU][mU] | 929 | 1757 |
| 993 | siRNA154-M0 | [mA][mA][mG][mC][mA][mG][mC][mU][A][C][U][G][A][mA][mG][mA][mA][mG][U][mG][mA] | 546 | 1358 | [mU][C][A][mC][U][U][C][U][U][C][mA][mG][U][A][G][mC][U][mG][C][U][mU][mU][mU] | 930 | 1758 |
| 994 | siRNA155-M0 | [mA][mG][mC][mA][mG][mC][mU][mA][C][U][G][A][A][mG][mA][mA][mG][mU][G][mA][mA] | 547 | 1359 | [mU][U][C][mA][C][U][U][C][U][U][mC][mA][G][U][A][mG][C][mU][G][C][mU][mU][mU] | 931 | 1759 |
| 995 | siRNA156-M0 | [mG][mC][mA][mG][mC][mU][mA][mC][U][G][A][A][G][mA][mA][mG][mU][mG][A][mA][mA] | 548 | 1360 | [mU][U][U][mC][A][C][U][U][C][U][mU][mC][A][G][U][mA][G][mC][U][G][mC][mU][mU] | 932 | 1760 |
| 996 | siRNA157-M0 | [mC][mA][mG][mC][mU][mA][mC][mU][G][A][A][G][A][mA][mG][mU][mG][mA][A][mA][mA] | 549 | 1361 | [mU][U][U][mU][C][A][C][U][U][C][mU][mU][C][A][G][mU][A][mG][C][U][mG][mU][mU] | 933 | 1761 |
| 1005 | siRNA158-M0 | [mA][mA][mG][mA][mA][mG][mU][mG][A][A][A][A][G][mA][mA][mC][mA][mU][U][mA][mA] | 550 | 1362 | [mU][U][A][mA][U][G][U][U][C][U][mU][mU][U][C][A][mC][U][mU][C][U][mU][mU][mU] | 934 | 1762 |
| 1006 | siRNA159-M0 | [mA][mG][mA][mA][mG][mU][mG][mA][A][A][A][G][A][mA][mC][mA][mU][mU][A][mG][mA] | 551 | 1364 | [mU][C][U][mA][A][U][G][U][U][C][mU][mU][U][U][C][mA][C][mU][U][C][mU][mU][mU] | 935 | 1763 |
| 1007 | siRNA160-M0 | [mG][mA][mA][mG][mU][mG][mA][mA][A][A][G][A][A][mC][mA][mU][mU][mA][G][mA][mA] | 552 | 1365 | [mU][U][C][mU][A][A][U][G][U][U][mC][mU][U][U][U][mC][A][mC][U][U][mC][mU][mU] | 936 | 1764 |
| 1011 | siRNA161-M0 | [mU][mG][mA][mA][mA][mA][mG][mA][A][C][A][U][U][mA][mG][mA][mG][mA][A][mU][mA] | 553 | 1366 | [mU][A][U][mU][C][U][C][U][A][A][mU][mG][U][U][C][mU][U][mU][U][C][mA][mU][mU] | 937 | 1765 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 1012 | siRNA162-M0 | [mG][mA][mA][mA][mA][mG][mA][mA][C][A][U][U][A][mG][mA][mG][mA][mA][U][mG][mA] | 554 | 1368 | [mU][C][A][mU][U][C][U][C][U][A][mA][mU][G][U][U][mC][U][mU][U][U][mC][mU][mU] | 938 | 1766 |
| 1013 | siRNA163-M0 | [mA][mA][mA][mA][mG][mA][mA][mC][A][U][U][A][G][mA][mG][mA][mA][mU][G][mC][mA] | 555 | 1369 | [mU][G][C][mA][U][U][C][U][C][U][mA][mA][U][G][U][mU][C][mU][U][U][mU][mU][mU] | 939 | 1767 |
| 1018 | siRNA164-M0 | [mA][mA][mC][mA][mU][mU][mA][mG][A][G][A][A][U][mG][mC][mU][mG][mG][U][mC][mA] | 556 | 1370 | [mU][G][A][mC][C][A][G][C][A][U][mU][mC][U][C][U][mA][A][mU][G][U][mU][mU][mU] | 940 | 1768 |
| 1019 | siRNA165-M0 | [mA][mC][mA][mU][mU][mA][mG][mA][G][G][A][U][G][mC][mU][mG][mG][mU][C][mA][mA] | 557 | 1371 | [mU][U][G][mA][C][C][A][G][C][A][mU][mU][C][U][C][mU][A][mA][U][G][mU][mU][mU] | 941 | 1769 |
| 1020 | siRNA166-M0 | [mC][mA][mU][mU][mA][mG][mA][mG][A][A][U][G][C][mU][mG][mG][mU][mC][A][mA][mA] | 558 | 1372 | [mU][U][U][mG][A][C][C][A][G][C][mA][mU][U][C][U][mC][U][mA][A][U][mG][mU][mU] | 942 | 1770 |
| 1021 | siRNA167-M0 | [mA][mU][mU][mA][mG][mA][mG][mA][A][U][G][C][U][mG][mG][mU][mC][mA][A][mA][mA] | 559 | 1373 | [mU][U][U][mU][G][A][C][C][A][G][mC][mA][U][U][C][mU][C][mU][A][A][mU][mU][mU] | 943 | 1771 |
| 1026 | siRNA168-M0 | [mA][mG][mA][mA][mU][mG][mC][mU][G][G][U][C][A][mA][mA][mA][mA][mG][U][mC][mA] | 560 | 1374 | [mU][G][A][m][U][U][U][U][U][G][mA][mC][C][A][G][mC][A][mU][U][C][mU][mU][mU] | 944 | 1772 |
| 1027 | siRNA169-M0 | [mG][mA][mA][mU][mG][mC][mU][mG][G][U][C][A][A][mA][mA][mA][mG][mU][C][mA][mA] | 561 | 1375 | [mU][U][G][mA][C][U][U][U][U][U][mG][mA][C][C][A][mG][C][mA][U][U][mC][mU][mU] | 945 | 1773 |
| 1029 | siRNA170-M0 | [mA][mU][mG][mC][mU][mG][mG][mU][C][A][A][A][A][mA][mG][mU][mC][mA][G][mC][mA] | 562 | 1376 | [mU][G][C][mU][G][A][C][U][U][U][mU][mU][G][A][C][mC][A][mG][C][C][mU][mU][mU] | 946 | 1774 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 1036 | siRNA171-M0 | [mU][mC][mA][mA][mA][mA][mA][mG][U][C][A][G][C][mU][mU][mG][mG][mA][A][mG][mA] | 563 | 1377 | [mU][C][U][mU][C][C][A][A][G][C][mU][mG][A][C][U][mU][U][mU][U][G][mA][mU][mU] | 947 | 1775 |
| 1039 | siRNA172-M0 | [mA][mA][mA][mA][mG][mU][mC][mA][G][C][U][U][G][mG][mA][mA][mG][mG][C][mA][mA] | 564 | 1378 | [mU][U][G][mC][C][U][U][C][C][A][mA][mG][C][U][G][mA][C][mU][U][U][mU][mU][mU] | 948 | 1776 |
| 1042 | siRNA173-M0 | [mA][mG][mU][mC][mA][mG][mC][mU][U][G][G][A][A][mG][mG][mC][mA][mA][U][mC][mA] | 565 | 1380 | [mU][G][A][mU][U][G][C][C][U][U][mC][mC][A][A][G][mC][U][mG][A][C][mU][mU][mU] | 949 | 1777 |
| 1084 | siRNA174-M0 | [mA][mC][mU][mG][mA][mA][mU][mG][A][C][C][U][G][mC][mC][mA][mG][mU][A][mU][mA] | 566 | 1381 | [mU][A][U][mA][C][U][G][G][C][A][mG][mG][U][C][A][mU][U][mC][A][G][mU][mU][mU] | 950 | 1778 |
| 1087 | siRNA175-M0 | [mG][mA][mA][mU][mG][mA][mC][mC][U][G][C][C][A][mG][mU][mA][mU][mU][A][mG][mA] | 567 | 1383 | [mU][C][U][mA][A][U][A][C][U][G][mG][mC][A][G][G][mU][C][mA][U][U][mC][mU][mU] | 951 | 1779 |
| 1134 | siRNA176-M0 | [mU][mU][mU][mC][mC][mA][mG][mU][G][C][C][U][C][mC][mC][mU][mC][mA][A][mC][mA] | 568 | 1384 | [mU][G][U][mU][G][A][G][G][G][A][mG][mG][C][A][C][mU][G][mG][A][A][mA][mU][mU] | 952 | 1780 |
| 1151 | siRNA177-M0 | [mA][mA][mC][mA][mU][mC][mC][mG][G][A][C][A][G][mC][mU][mA][mA][mG][G][mA][mA] | 569 | 1385 | [mU][U][C][mC][U][U][A][G][G][A][mG][mG][C][C][G][mG][A][mU][G][U][mU][mU][mU] | 953 | 1781 |
| 1152 | siRNA178-M0 | [mA][mC][mA][mU][mC][mC][mG][mG][A][C][A][G][C][mU][mA][mA][mG][mG][A][mG][mA] | 570 | 1386 | [mU][C][U][mC][C][U][U][A][G][C][mU][mG][U][C][C][mG][G][mA][U][G][mU][mU][mU] | 954 | 1782 |
| 1155 | siRNA179-M0 | [mU][mC][mC][mG][mG][mA][mC][mA][G][C][U][A][A][mG][mG][mA][mG][mG][A][mU][mA] | 571 | 1387 | [mU][A][U][mC][C][U][C][C][U][U][mA][mG][C][U][G][mU][C][mC][G][G][mA][mU][mU] | 955 | 1783 |

TABLE 5B-continued

| siRNAs for in vitro Screening‡ | | | | | | | |
|---|---|---|---|---|---|---|---|
| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
| 1158 | siRNA180-M0 | [mG][mG][mA][mC][mA][mG][mC][mU][A][A][G][G][A][mG][mG][mA][mU][mU][U][mC][mA] | 572 | 1388 | [mU][G][A][mA][A][U][C][C][U][C][mC][mU][U][A][G][mC][U][mG][U][C][mC][mU][mU] | 956 | 1784 |
| 1160 | siRNA181-M0 | [mA][mC][mA][mG][mC][mU][mA][mA][G][G][A][G][G][mA][mU][mU][mU][mC][A][mC][mA] | 573 | 1389 | [mU][G][U][mG][A][A][A][U][C][C][mU][mC][C][U][U][mA][G][mC][U][G][mU][mU][mU] | 957 | 1785 |
| 1162 | siRNA182-M0 | [mA][mG][mC][mU][mA][mA][mG][mG][A][G][G][A][U][mU][mU][mC][mA][mC][U][mU][mA] | 574 | 1390 | [mU][A][A][mG][U][G][A][A][A][U][mC][mC][U][C][C][mU][U][mA][G][C][mU][mU][mU] | 958 | 1786 |
| 1165 | siRNA183-M0 | [mU][mA][mA][mG][mG][mA][mG][mG][A][U][U][U][C][mA][mC][mU][mU][mU][G][mC][mA] | 575 | 1391 | [mU][G][C][mA][A][A][G][U][G][A][mA][mA][U][C][C][mU][C][mC][U][U][mA][mU][mU] | 959 | 1787 |
| 1168 | siRNA184-M0 | [mG][mG][mA][mG][mG][mA][mU][mU][U][C][A][C][U][mU][mU][mG][mC][mA][C][mC][mA] | 576 | 1392 | [mU][G][G][mU][G][C][A][A][A][G][mU][mG][A][A][A][mU][C][mC][U][C][mC][mU][mU] | 960 | 1788 |
| 1169 | siRNA185-M0 | [mG][mA][mG][mG][mA][mU][mU][mU][C][A][C][U][U][mU][mG][mC][mA][mC][C][mU][mA] | 577 | 1393 | [mU][A][G][mG][U][G][C][A][A][A][mG][mU][G][A][A][mA][U][mC][C][U][mC][mU][mU] | 961 | 1789 |
| 1174 | siRNA186-M0 | [mU][mU][mU][mC][mA][mC][mU][mU][U][G][C][A][C][mC][mU][mU][mG][mA][G][mG][mA] | 578 | 1394 | [mU][C][C][mU][C][A][A][G][G][U][mG][mC][A][A][A][mG][U][mG][A][A][mA][mU][mU] | 962 | 1790 |
| 1177 | siRNA187-M0 | [mC][mA][mC][mU][mU][mU][mG][mC][A][C][C][U][U][mG][mA][mG][mG][mA][C][mG][mA] | 579 | 1395 | [mU][C][G][mU][C][C][U][C][A][A][mG][mG][U][G][C][mA][A][mA][G][U][mG][mU][mU] | 963 | 1791 |
| 1178 | siRNA188-M0 | [mA][mC][mU][mU][mU][mG][mC][mA][C][C][U][U][G][mA][mG][mG][mA][mC][G][mG][mA] | 580 | 1396 | [mU][C][C][mG][U][C][C][U][C][A][mA][mG][G][U][G][mC][A][mA][A][G][mU][mU][mU] | 964 | 1792 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 1189 | siRNA189-M0 | [mU][mG][mA][mG][mG][mA][mC][mG][G][U][U][C][C][mU][mA][mC][mA][mA][C][mA][mA] | 581 | 1397 | [mU][U][G][mU][U][G][U][A][G][G][mA][mA][C][C][G][mU][C][mC][U][C][mA][mU][mU] | 965 | 1793 |
| 1191 | siRNA190-M0 | [mA][mG][mG][mA][mC][mG][mG][mU][U][C][C][U][A][mC][mA][mA][mC][mA][U][mC][mA] | 582 | 1398 | [mU][G][A][mU][G][U][U][G][U][A][mG][mG][A][A][C][mC][G][mU][C][C][mU][mU][mU] | 966 | 1794 |
| 1194 | siRNA191-M0 | [mA][mC][mG][mG][mU][mU][mC][mC][U][A][C][A][A][mC][mA][mU][mC][mC][G][mA][mA] | 583 | 1400 | [mU][U][C][mG][G][A][U][G][U][U][mG][mU][A][G][G][mA][A][mC][C][G][mU][mU][mU] | 967 | 1795 |
| 1196 | siRNA192-M0 | [mG][mG][mU][mU][mC][mC][mU][mA][C][A][A][C][A][mU][mC][mC][mG][mA][A][mA][mA] | 584 | 1401 | [mU][U][U][mU][C][G][G][A][U][G][mU][mU][G][U][A][mG][G][mA][A][C][mC][mU][mU] | 968 | 1796 |
| 1200 | siRNA193-M0 | [mC][mC][mU][mA][mC][mA][mA][mC][A][U][C][C][G][mA][mA][mA][mA][mG][A][mU][mA] | 585 | 1402 | [mU][A][U][mC][U][U][U][U][C][G][mG][mA][U][G][U][mU][G][mU][A][G][mG][mU][mU] | 969 | 1797 |
| 1201 | siRNA194-M0 | [mC][mU][mA][mC][mA][mA][mC][mA][U][C][C][G][A][mA][mA][mA][mG][mA][U][mG][mA] | 586 | 1403 | [mU][C][A][mU][C][U][U][U][U][C][mG][mG][A][U][G][mU][U][mG][U][A][mG][mU][mU] | 970 | 1798 |
| 1203 | siRNA195-M0 | [mA][mC][mA][mA][mC][mA][mU][mC][C][G][A][A][A][mA][mG][mA][mU][mG][A][mC][mA] | 587 | 1404 | [mU][G][U][C][A][U][C][U][U][U][mU][mC][G][G][A][mU][G][mU][U][G][mU][mU][mU] | 971 | 1799 |
| 1204 | siRNA196-M0 | [mC][mA][mA][mC][mA][mU][mC][mC][G][A][A][A][A][mG][mA][mU][mG][mA][C][mA][mA] | 588 | 1405 | [mU][U][G][mU][C][A][U][C][U][U][mU][mU][C][G][G][mA][U][mG][U][U][mG][mU][mU] | 972 | 1800 |
| 1205 | siRNA197-M0 | [mA][mA][mC][mA][mU][mC][mC][mG][A][A][A][A][G][mA][mU][mG][mA][mC][A][mU][mA] | 589 | 1406 | [mU][A][U][mG][U][C][A][U][C][U][mU][mU][U][C][G][mG][A][mU][G][U][mU][mU][mU] | 973 | 1801 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 1207 | siRNA198-M0 | [mC][mA][mU][mC][mC][mG][mA][mA][A][A][G][A][U][mG][mA][mC][mA][mU][C][mA][mA] | 590 | 1407 | [mU][U][G][mA][U][G][U][C][A][U][mC][mU][U][U][U][mC][G][mG][A][U][mG][mU][mU] | 974 | 1802 |
| 1209 | siRNA199-M0 | [mU][mC][mC][mG][mA][mA][mA][mA][G][A][U][G][A][mC][mA][mU][mC][mA][U][mA][mA] | 591 | 1408 | [mU][U][A][mU][G][A][U][G][U][C][mA][mU][C][U][U][mU][U][mC][G][G][mA][mU][mU] | 975 | 1803 |
| 1212 | siRNA200-M0 | [mG][mA][mA][mA][mA][mG][mA][mU][G][A][C][A][U][mC][mA][mU][mA][mG][C][mU][mA] | 592 | 1410 | [mU][A][G][mC][U][A][U][G][A][U][mG][mU][C][A][U][mC][U][mU][U][U][mC][mU][mU] | 976 | 1804 |
| 1214 | siRNA201-M0 | [mA][mA][mA][mG][mA][mU][mG][mA][C][A][U][C][A][mU][mA][mG][mC][mU][C][mU][mA] | 593 | 1411 | [mU][A][G][mA][G][C][U][A][U][G][mA][mU][G][U][C][mA][U][mC][U][U][mU][mU][mU] | 977 | 1805 |
| 1215 | siRNA202-M0 | [mA][mA][mG][mA][mU][mG][mA][mC][A][U][C][A][U][mA][mG][mC][mU][mC][U][mU][mA] | 594 | 1412 | [mU][A][A][mG][A][G][C][U][A][U][mG][mA][U][G][U][mC][A][mU][C][U][mU][mU][mU] | 978 | 1806 |
| 1217 | siRNA203-M0 | [mG][mA][mU][mG][mA][mC][mA][mU][C][A][U][A][G][mC][mU][mC][mU][mU][U][mA][mA] | 595 | 1413 | [mU][U][A][mA][A][G][A][G][C][U][mA][mU][G][A][U][mG][U][mC][A][U][mC][mU][mU] | 979 | 1807 |
| 1226 | siRNA204-M0 | [mA][mU][mA][mG][mC][mU][mC][mU][U][U][A][C][C][mC][mA][mC][mA][mG][U][mU][mA] | 596 | 1415 | [mU][A][A][mC][U][G][U][G][G][G][mU][mA][A][A][G][mA][G][mC][U][A][mU][mU][mU] | 980 | 1808 |
| 1227 | siRNA205-M0 | [mU][mA][mG][mC][mU][mC][mU][mU][U][A][C][C][C][mA][mC][mA][mG][mU][U][mA][mA] | 597 | 1416 | ][U][G][G][mG][mU][A][][U][G][G][mG][mA][A][A][A][mG][A][mG][C][U][mA][mU][mU] | 981 | 1809 |
| 1228 | siRNA206-M0 | [mA][mG][mC][mU][mC][mU][mU][mU][A][C][C][C][A][mC][mA][mG][mU][mU][A][mA][mA] | 598 | 1419 | [mU][U][U][mA][A][C][U][G][U][G][mG][mG][U][A][A][mA][G][mA][G][C][mU][mU][mU] | 982 | 1810 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 1229 | siRNA207-M0 | [mG][mC][mU][mC][mU][mU][mU][mA][C][C][C][A][C][mA][mG][mU][mU][mA][A][mU][mA] | 599 | 1420 | [mU][A][U][mU][A][A][C][U][G][U][mG][mG][G][U][A][mA][A][mG][A][G][mC][mU][mU] | 983 | 1811 |
| 1230 | siRNA208-M0 | [mC][mU][mC][mU][mU][mU][mA][mC][C][C][A][C][A][mG][mU][mU][mA][mA][U][mG][mA] | 600 | 1421 | [mU][C][A][mU][U][A][A][C][U][G][mU][mG][G][G][U][mA][A][mA][G][A][mG][mU][mU] | 984 | 1812 |
| 1231 | siRNA209-M0 | [mU][mC][mU][mU][mU][mA][mC][mC][C][A][C][A][G][mU][mU][mA][mA][mU][G][mC][mA] | 601 | 1422 | [mU][G][C][mA][U][U][A][A][C][U][mG][mU][G][G][G][mU][A][mA][A][G][mA][mU][mU] | 985 | 1813 |
| 1233 | siRNA210-M0 | [mU][mU][mU][mA][mC][mC][mC][mA][C][A][G][U][U][mA][mA][mU][mG][mC][A][mC][mA] | 602 | 1423 | [mU][G][U][mG][C][A][U][U][A][A][mC][mU][G][U][G][mG][G][mU][A][A][mA][mU][mU] | 986 | 1814 |
| 1236 | siRNA211-M0 | [mA][mC][mC][mC][mA][mC][mA][mG][U][U][A][A][U][mG][mC][mA][mC][mU][U][mA][mA] | 603 | 1424 | [mU][U][A][mA][G][U][G][C][A][U][mU][mA][A][C][U][mG][U][mG][G][G][mU][mU][mU] | 987 | 1815 |
| 1237 | siRNA212-M0 | [mC][mC][mC][mA][mC][mA][mG][mU][U][A][A][U][G][mC][mA][mC][mU][mU][A][mG][mA] | 604 | 1426 | [mU][C][U][mA][A][G][U][G][C][A][mU][mU][A][G][C][A][mU][mU][A][mG][mU][mU] | 988 | 1816 |
| 1238 | siRNA213-M0 | [mC][mC][mA][mC][mA][mG][mU][mU][A][A][U][G][C][mA][mC][mU][mU][mA][G][mA][mA] | 605 | 1427 | [mU][U][C][mU][A][A][G][U][G][C][mA][mU][U][A][A][C][mG][mU][G][mG][mU][mU] | 989 | 1817 |
| 1239 | siRNA214-M0 | [mC][mA][mC][mA][mG][mU][mU][mA][A][U][G][C][A][mC][mU][mU][mA][mG][A][mU][mA] | 606 | 1428 | [mU][A][U][mC][U][A][A][G][U][G][mC][mA][U][U][A][mA][C][mU][G][U][mG][mU][mU] | 990 | 1818 |
| 1240 | siRNA215-M0 | [mA][mC][mA][mG][mU][mU][mA][mA][U][G][C][A][C][mU][mU][mA][mG][mA][U][mC][mA] | 607 | 1429 | [mU][G][A][mU][C][U][A][A][G][U][mG][mC][A][U][U][mA][A][mC][U][G][mU][mU][mU] | 991 | 1819 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 1241 | siRNA216-M0 | [mC][mA][mG][mU][mU][mU][mA][mA][U][G][C][A][C][mU][mA][mG][mA][mU][C][mC][mA] | 608 | 1430 | [mU][G][G][mA][U][C][U][A][A][G][mU][mG][C][A][U][mU][A][mA][C][U][mG][mU][mU] | 992 | 1820 |
| 1242 | siRNA217-M0 | [mA][mG][mU][mU][mA][mA][mU][mG][C][A][C][U][U][mA][mG][mA][mU][mC][C][mA][mA] | 609 | 1431 | [mU][U][G][mG][A][U][C][U][A][A][mG][mU][G][C][A][mU][U][mA][A][C][mU][mU][mU] | 993 | 1821 |
| 1248 | siRNA218-M0 | [mU][mG][mC][mA][mC][mU][mU][mA][G][A][U][C][C][mA][mG][mA][mA][mA][U][mC][mA | 610 | 1432 | [mU][G][A][mU][U][U][C][U][G][G][mA][mU][C][U][A][mA][G][mU][G][C][mA][mU][mU] | 994 | 1822 |
| 1249 | siRNA219-M0 | [mG][mC][mA][mC][mU][mU][mA][mG][A][U][C][C][A][mG][mA][mA][mA][mU][C][mU][mA] | 611 | 1433 | [mU][A][G][mA][U][U][U][C][U][G][mG][mA][U][C][U][mA][A][mG][U][G][mC][mU][mU | 995 | 1823 |
| 1261 | siRNA220-M0 | [mA][mG][mA][mA][mA][mU][mC][mU][A][C][C][C][A][mG][mA][mC][mC][mC][U][mU][mA] | 612 | 1434 | [mU][A][A][mG][G][G][U][C][U][G][mG][mG][U][A][G][mA][U][mU][U][C][mU][mU][mU] | 996 | 1824 |
| 1283 | siRNA221-M0 | [mA][mC][mU][mU][mU][mU][mA][mA][A][U][A][U][G][mA][mU][mA][mG][mG][U][mA][mA] | 613 | 1435 | [mU][U][A][mC][C][U][A][U][C][A][mU][mA][U][U][U][mA][A][mA][A][G][mU][mU][mU] | 997 | 1825 |
| 1285 | siRNA222-M0 | [mU][mU][mU][mU][mA][mA][mA][mU][A][U][G][A][U][mA][mG][mG][mU][mA][U][mC][mA] | 614 | 1436 | [mU][G][A][mU][A][C][C][U][A][U][mC][mA][U][A][U][mU][U][mA][A][A][mA][mU][mU] | 998 | 1826 |
| 1286 | siRNA223-M0 | [mU][mU][mU][mA][mA][mA][mU][mA][U][G][A][U][A][mG][mG][mU][mA][mU][C][mU][mA] | 615 | 1437 | [mU][A][G][mA][U][A][C][C][U][A][mU][mC][A][U][A][mU][U][mU][A][A][mA][mU][mU] | 999 | 1827 |
| 1288 | siRNA224-M0 | [mU][mA][mA][mA][mU][mA][mU][mG][A][U][A][G][G][mU][mA][mU][mC][mU][U][mG][mA] | 616 | 1438 | [mU][C][A][mA][G][A][U][A][C][C][mU][mA][U][C][A][mU][A][mU][U][U][mA][mU][mU] | 1000 | 1828 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 1290 | siRNA225-M0 | [mA][mA][mU][mA][mU][mG][mA][mU][A][G][G][U][A][mU][mC][mU][mU][mG][A[mU][mA] | 617 | 1439 | [mU][A][U][mC][A][A][G][A][U][A][mC][mC][U][A][U][mC][A][mU][A][U][mU][mU][mU] | 1001 | 1829 |
| 1291 | siRNA226-M0 | [mA][mU][mA][mU][mG][mA][mU][mA][G][G][U][A][U][mC][mU][mU][mG][mA][U][mG][mA] | 618 | 1440 | [mU][C][A][mU][C][A][A][G][A][U][mA][mC][C][U][A][mU][C][mA][U][A][mU][mU][mU] | 1002 | 1830 |
| 1292 | siRNA227-M0 | [mU][mA][mU][mG][mA][mU][mA][mG][G][U][A][U][C][m][mU][mG][mA][mU][G][mA][mA] | 619 | 1442 | [mU][U][C][mA][U][C][A][A][G][A][mU][mA][C][C][U][mA][U][mC][A][U][mA][mU][mU] | 1003 | 1831 |
| 1293 | siRNA228-M0 | [mA][mU][mG][mA][mU][mA][mG][mG][U][A][U][C][U][mU][mG][mA][mU][mG][A][mA][mA] | 620 | 1443 | [mU][U][U][mC][A][U][C][A][A][G][mA][mU][A][C][C][mU][A][mU][C][A][mU][mU][mU] | 1004 | 1832 |
| 1296 | siRNA229-M0 | [mA][mU][mA][mG][mG][mU][mA][mU][C][U][U][G][A][mU][mG][mA][mA][mA][A][mC][mA] | 621 | 1444 | [mU][G][U][mU][U][U][C][A][U][C][mA][mA][G][A][U][mA][C][mC][U][A][mU][mU][mU] | 1005 | 1833 |
| 1297 | siRNA230-M0 | [mU][mA][mG][mG][mU][mA][mU][mC][U][U][G][A][U][mG][mA][mA][mA][mA][C][mG][mA] | 622 | 1445 | [mU][C][G][mU][U][U][U][C][A][U][mC][mA][A][G][A][mU][A][mC][C][U][mA][mU][mU] | 1006 | 1834 |
| 1298 | siRNA231-M0 | [mA][mG][mG][mU][mA][mU][mC][mU][U][G][A][U][G][mA][mA][mA][mA][mC][G][mG][mA] | 623 | 1446 | [mU][C][C][mG][U][U][U][U][C][U][mU][mC][A][A][G][mA][U][mA][C][C][mU][mU][mU] | 1007 | 1835 |
| 1299 | siRNA232-M0 | [mG][mG][mU][mA][mU][mC][mU][mU][G][A][U][G][A][mA][mA][mA][mC][mG][G][mG][mA] | 624 | 1448 | [mU][C][C][mC][G][U][U][U][U][C][mA][mU][C][A][A][mG][A][mU][A][C][mC][mU][mU] | 1008 | 1836 |
| 1300 | siRNA233-M0 | [mG][mU][mA][mU][mC][mU][mU][mG][A][U][G][A][A][mA][mA][mC][mG][mG][G][mA][mA] | 625 | 1449 | [mU][U][C][mC][C][G][U][U][U][U][mC][mA][U][C][A][mA][G][mA][U][A][mC][mU][mU] | 1009 | 1837 |

TABLE 5B-continued

| siRNAs for in vitro Screening‡ | | | | | | | | |
|---|---|---|---|---|---|---|---|---|
| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
| 1301 | siRNA234-M0 | [mU][mA][mU][mC][mU][mU][mG][mA][U][G][A][A][A][mA][mC][mG][mG][mG][A][mA][mA] | 626 | 1450 | [mU][U][U][mC][C][C][G][U][U][U][mU][mC][A][U][C][mA][A][mG][A][U][mA][mU][mU] | 1010 | 1838 |
| 1302 | siRNA235-M0 | [mA][mU][mC][mU][mU][mG][mA][mU][G][A][A][A][A][mC][mG][mG][mG][mA][A][mG][mA] | 627 | 1451 | [mU][C][U][mU][C][C][C][G][U][U][mU][mU][C][A][U][mC][A][mA][G][A][mU][mU][mU] | 1011 | 1839 |
| 1303 | siRNA236-M0 | [mU][mC][mU][mU][mG][mA][mU][mG][A][A][A][A][C][mG][mG][mG][mA][mA][G][mA][mA] | 628 | 1452 | [mU][U][C][mU][U][U][C][C][G][U][mU][mU][U][C][A][mU][C][mA][A][G][mA][mU][mU] | 1012 | 1840 |
| 1306 | siRNA237-M0 | [mU][mG][mA][mU][mG][mA][mA][mA][A][C][G][G][G][mA][mA][mG][mA][mC][A][mA][mA] | 629 | 1453 | [mU][U][U][mG][U][C][U][U][C][C][mC][mG][U][U][U][mU][C][mA][U][C][mA][mU][mU] | 1013 | 1841 |
| 1307 | siRNA238-M0 | [mG][mA][mU][mG][mA][mA][mA][mA][C][G][G][G][A][mA][mG][mA][mC][mA][A][mA][mA] | 630 | 1454 | [mU][U][U][mU][G][U][C][U][U][C][mC][mC][G][U][U][mU][U][mC][A][U][mC][mU][mU] | 1014 | 1842 |
| 1311 | siRNA239-M0 | [mA][mA][mA][mA][mC][mG][mG][mG][A][A][G][A][C][mA][mA][mA][mG][mA][C][mU][mA] | 631 | 1455 | [mU][A][G][mU][C][U][U][U][G][U][mC][mU][U][C][C][mC][G][mU][U][U][mU][mU][mU] | 1015 | 1843 |
| 1313 | siRNA240-M0 | [mA][mA][mC][mG][mG][mG][mA][mA][G][A][C][A][A][mA][mG][mA][mC][mU][A][mC][mA] | 632 | 1456 | [mU][G][U][mA][G][U][C][U][U][U][mG][mU][C][U][U][mC][C][mC][G][U][mU][mU][mU] | 1016 | 1844 |
| 1314 | siRNA241-M0 | [mA][mC][mG][mG][mG][mA][mA][mG][A][C][A][A][A][mG][mA][mC][mU][mA][C][mC][mA] | 633 | 1457 | [mU][G][G][mU][A][G][U][C][U][U][mU][mG][U][C][U][mU][C][mC][C][G][mU][mU][mU] | 1017 | 1845 |
| 1353 | siRNA242-M0 | [mA][mG][mU][mU][mA][mA][mA][mG][U][A][U][U][A][mC][mU][mA][mC][mA][U][mG][mA] | 634 | 1458 | [mU][C][A][mU][G][U][A][G][U][A][mA][mU][A][C][U][mU][U][mA][A][C][mU][mU][mU] | 1018 | 1846 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 1354 | siRNA243-M0 | [mG][mU][mU][mA][mA][mA][mG][mU][A][U][U][A][C][mU][mA][mC][mA][mU][G][mC][mA] | 635 | 1459 | [mU][G][C][mA][U][G][U][A][G][U][mA][mA][U][A][C][mU][U][mU][A][A][mC][mU][mU] | 1019 | 1847 |
| 1358 | siRNA244-M0 | [mA][mA][mG][mU][mA][mU][mU][mA][C][U][A][C][A][mU][mG][mC][mC][mC][U][mU][mA] | 636 | 1460 | [mU][A][A][mG][G][G][C][A][U][G][mU][mA][G][U][A][mA][U][mA][C][U][mU][mU][mU] | 1020 | 1848 |
| 1360 | siRNA245-M0 | [mG][mU][mA][mU][mU][mA][mC][mU][A][C][A][U][G][mC][mC][mC][mU][mU][U][mG][mA] | 637 | 1461 | [mU][C][A][mA][A][G][G][G][C][A][mU][mG][U][A][G][mU][A][mA][U][A][mC][mU][mU] | 1021 | 1849 |
| 1361 | siRNA246-M0 | [mU][mA][mU][mU][mA][mC][mU][mA][C][A][U][G][C][mC][mC][mU][mU][mU][G][mG][mA] | 638 | 1462 | [mU][C][C][mA][A][A][G][G][G][C][mA][mU][G][U][A][mG][U][mA][A][U][mA][mU][mU] | 1022 | 1850 |
| 1363 | siRNA247-M0 | [mU][mU][mA][mC][mU][mA][mC][mA][U][G][C][C][C][mU][mU][mU][mG][mG][A][mU][mA] | 639 | 1463 | [mU][A][U][mC][C][A][A][A][G][G][mG][mC][A][U][G][mU][A][mG][U][A][mA][mU][mU] | 1023 | 1851 |
| 1364 | siRNA248-M0 | [mU][mA][mC][mU][mA][mC][mA][mU][G][C][C][C][U][mU][mU][mG][mG][mA][U][mC][mA] | 640 | 1464 | [mU][G][A][mU][C][C][A][A][A][G][mG][mG][C][A][U][mG][U][mA][G][U][mA][mU][mU] | 1024 | 1852 |
| 1382 | siRNA249-M0 | [mU][mC][mG][mG][mG][mA][mG][mC][U][A][C][A][A][mU][mA][mU][mG][mU][C][mC][mA] | 641 | 1465 | [mU][G][G][mA][C][A][U][A][U][U][mG][mU][A][G][C][mU][C][mC][C][G][mA][mU][mU] | 1025 | 1853 |
| 1386 | siRNA250-M0 | [mG][mA][mG][mC][mU][mA][mC][mA][A][U][A][U][G][mU][mC][mC][mU][mG][G][mA][mA] | 642 | 1466 | [mU][U][C][mC][A][G][G][A][C][A][mU][mA][U][U][G][mU][A][mG][C][U][mC][mU][mU] | 1026 | 1854 |
| 1388 | siRNA251-M0 | [mG][mC][mU][mA][mC][mA][mA][mU][A][U][G][U][C][mC][mU][mG][mG][mA][A][mG][mA] | 643 | 1468 | [mU][C][U][mU][C][C][A][G][G][A][mC][mA][U][A][U][mU][G][mU][A][G][mC][mU][mU] | 1027 | 1855 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 1389 | siRNA252-M0 | [mC][mU][mA][mC][mA][mA][mU][mA][U][G][U][C][C][mU][mG][mG][mA][mA][G][mA][mA] | 644 | 1469 | [mU][U][C][mU][U][C][C][A][G][G][mA][mC][A][U][A][mU][U][mG][U][A][mG][mU][mU] | 1028 | 1856 |
| 1413 | siRNA253-M0 | [mU][mC][mG][mC][mU][mA][mU][mC][C][A][C][G][A][mA][mA][mU][mC][mA][A][mG][mA] | 645 | 1470 | [mU][C][U][mU][G][A][U][U][U][C][mG][mU][G][mU][C][U][mU][G][A][U][mA][mU][mU] | 1029 | 1857 |
| 1415 | siRNA254-M0 | [mG][mC][mU][mA][mU][mC][mC][mA][C][G][A][A][A][mU][mC][mA][mA][mG][C][mA][mA] | 646 | 1471 | [mU][U][G][mC][U][U][G][A][U][U][mU][mC][G][U][G][mG][A][mU][A][G][mC][mU][mU] | 1030 | 1858 |
| 1416 | siRNA255-M0 | [mC][mU][mA][mU][mC][mC][mA][mC][G][A][A][A][U][mC][mA][mA][mG][mC][A][mA][mA] | 647 | 1472 | [mU][U][U][mG][C][U][U][G][A][U][mU][mU][C][G][U][mG][G][mA][U][A][mG][mU][mU] | 1031 | 1859 |
| 1417 | siRNA256-M0 | [mU][mA][mU][mC][mC][mA][mC][mG][A][A][A][U][C][mA][mA][mG][mC][mA][A][mU][mA] | 648 | 1473 | [mU][A][U][mU][G][C][U][U][U][G][A][mU][mU][U][C][G][mU][G][mG][A][U][mA][mU][mU] | 1032 | 1860 |
| 1424 | siRNA257-M0 | [mG][mA][mA][mA][mU][mC][mA][mA][G][C][A][A][U][mU][mU][mU][mU][mG][A][mU][mA] | 649 | 1475 | [mU][A][U][mC][A][A][A][A][A][U][mU][mG][C][U][U][mG][A][mU][U][U][mC][mU][mU] | 1033 | 1861 |
| 1425 | siRNA258-M0 | [mA][mA][mA][mU][mC][mA][mA][mG][C][A][A][U][U][mU][mU][mU][mG][mA][U][mU][mA] | 650 | 1476 | [mU][A][A][mU][C][A][A][A][A][A][mU][mU][G][C][U][mU][G][mA][U][U][mU][mU][mU] | 1034 | 1862 |
| 1431 | siRNA259-M0 | [mA][mG][mC][mA][mA][mU][mU][mU][U][U][G][A][U][mU][mC][mU][mG][mA][U][mG][mA] | 651 | 1477 | [mU][C][A][mU][C][A][G][A][A][U][mC][mA][A][A][A][mA][U][mU][G][C][mU][mU][mU] | 1035 | 1863 |
| 1433 | siRNA260-M0 | [mC][mA][mA][mU][mU][mU][mU][mU][G][A][U][U][C][mU][mG][mA][mU][mG][C][mU][mA] | 652 | 1478 | [mU][A][G][mC][A][U][C][A][G][A][mA][mU][C][A][A][mA][A][mA][U][U][mG][mU][mU] | 1036 | 1864 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 1506 | siRNA261-M0 | [mA][mC][mC][mA][mG][mU][mC][mC][C][G][G][G][C][mA][mG][mG][mC][mU][U][mG][mA] | 653 | 1480 | [mU][C][A][mA][G][C][C][U][G][C][mC][mC][G][G][G][mA][C][mU][G][G][mU][mU][mU] | 1037 | 1865 |
| 1507 | siRNA262-M0 | [mC][mC][mA][mG][mU][mC][mC][mC][G][G][G][C][A][mG][mG][mC][mU][mU][G][mG][mA] | 654 | 1481 | [mU][C][C][mA][A][G][C][C][U][G][mC][mC][C][G][G][mG][A][mC][U][G][mG][mU][mU] | 1038 | 1866 |
| 1510 | siRNA263-M0 | [mG][mU][mC][mC][mC][mG][mG][mG][C][A][G][G][C][mU][mU][mG][mG][mG][C][mA][mA] | 655 | 1482 | [mU][U][G][mC][C][C][A][A][G][C][mC][mU][G][C][C][mC][G][mG][G][A][mC][mU][mU] | 1039 | 1867 |
| 1511 | siRNA264-M0 | [mU][mC][mC][mC][mG][mG][mG][mC][A][G][G][C][U][mU][mG][mG][mG][mC][A][mU][mA] | 656 | 1483 | [mU][A][U][mG][C][C][C][A][A][G][mC][mC][U][C][C][mC][C][mG][G][G][mA][mU][mU] | 1040 | 1868 |
| 1513 | siRNA265-M0 | [mC][mC][mG][mG][mG][mC][mA][mG][G][C][U][U][G][mG][mG][mC][mA][mU][U][mU][mA] | 657 | 1484 | [mU][A][A][mA][U][G][C][C][C][A][mA][mG][C][C][U][mG][C][mC][C][G][mG][mU][mU] | 1041 | 1869 |
| 1518 | siRNA266-M0 | [mC][mA][mG][mG][mC][mU][mU][mG][G][G][C][A][U][mU][mU][mU][mG][mC][C][mG][mA] | 658 | 1485 | [mU][C][G][mG][C][A][A][A][A][U][mG][mC][C][C][A][mA][G][mC][C][U][mG][mU][mU] | 1042 | 1870 |
| 1555 | siRNA267-M0 | [mA][mU][mU][mU][mA][mA][mA][mU][A][U][A][A][A][mU][mU][mC][mA][mA][G][mC][mA] | 659 | 1486 | [mU][G][C][mU][U][G][A][A][U][U][mU][mA][U][A][U][mU][U][mA][A][A][mU][mU][mU] | 1043 | 1871 |
| 1556 | siRNA268-M0 | [mU][mU][mU][mA][mA][mA][mU][mA][U][A][A][A][U][mU][mC][mA][mA][mG][C][mA][mA] | 660 | 1487 | [mU][U][G][mC][U][U][G][A][A][U][mU][mU][A][U][A][mU][U][mU][A][A][mA][mU][mU] | 1044 | 1872 |
| 1557 | siRNA269-M0 | [mU][mU][mA][mA][mA][mU][mA][mU][A][A][A][U][U][mC][mA][mA][mG][mC][A][mU][mA] | 661 | 1488 | [mU][A][U][mG][C][U][U][A][A][A][mU][mU][U][A][U][mA][U][mU][U][A][mA][mU][mU] | 1045 | 1873 |

TABLE 5B-continued

| siRNAs for in vitro Screening‡ | | | | | | | |
|---|---|---|---|---|---|---|---|
| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
| 1558 | siRNA270-M0 | [mU][mA][mA][mA][mU][mA][mU][mA][A][A][U][U][C][mA][mA][mG][mC][mA][U][mU][mA] | 662 | 1489 | [mU][A][A][mU][G][C][U][U][G][A][mA][mU][U][U][A][mU][A][mU][U][U][mA][mU][mU] | 1046 | 1874 |
| 1559 | siRNA271-M0 | [mA][mA][mA][mU][mA][mU][mA][mA][A][U][U][C][A][mA][mG][mC][mA][mU][U][mU][mA] | 663 | 1490 | [mU][A][A][mA][U][G][C][U][U][G][mA][mA][U][U][U][mA][U][mA][U][U][mU][mU][mU] | 1047 | 1875 |
| 1561 | siRNA272-M0 | [mA][mU][mA][mU][mA][mA][mA][mU][U][C][A][A][G][mC][mA][mU][mU][mU][G][mU][mA] | 664 | 1491 | [mU][A][C][mA][A][A][U][G][C][U][mU][mG][A][A][U][mU][U][mA][U][A][mU][mU][mU] | 1048 | 1876 |
| 1593 | siRNA273-M0 | [mG][mG][mA][mA][mU][mA][mA][mG][A][G][G][A][C][mA][mC][mU][mA][mG][A][mU][mA] | 665 | 1493 | [mU][A][U][mC][U][A][G][U][G][U][mC][mC][U][C][U][mU][A][mU][U][C][mC][mU][mU] | 1049 | 1877 |
| 1594 | siRNA274-M0 | [mG][mA][mA][mU][mA][mA][mG][mA][G][G][A][C][A][mC][mU][mA][mG][mA][U][mG][mA] | 666 | 1494 | [mU][C][A][mU][C][U][A][G][U][G][mU][mC][C][U][C][mU][U][mA][U][U][mC][mU][mU] | 1050 | 1878 |
| 1597 | siRNA275-M0 | [mU][mA][mA][mG][mA][mG][mG][mA][C][A][C][U][A][mG][mA][mU][mG][mA][U][mA][mA] | 667 | 1495 | [mU][U][A][mU][C][A][U][C][U][A][mG][mU][G][U][C][mC][U][mC][U][U][mA][mU][mU] | 1051 | 1879 |
| 1599 | siRNA276-M0 | [mA][mG][mA][mG][mG][mA][mC][mA][C][U][A][G][A][mU][mG][mA][mU][mA][U][mU][mA] | 668 | 1496 | [mU][A][A][mU][A][U][C][A][U][C][mU][mA][G][U][G][mU][C][mC][U][C][mU][mU][mU] | 1052 | 1880 |
| 1601 | siRNA277-M0 | [mA][mG][mG][mA][mC][mA][mC][mU][A][G][A][U][G][mA][mU][mA][mU][mU][A][mC][mA] | 669 | 1497 | [mU][G][U][mA][A][U][A][U][C][A][mU][mC][U][U][G][mU][C][mC][U][C][mU][mU][mU] | 1053 | 1881 |
| 1605 | siRNA278-M0 | [mC][mA][mC][mU][mA][mG][mA][mU][G][A][U][A][U][mU][mA][mC][mA][mG][G][mA][mA] | 670 | 1498 | [mU][U][C][mC][U][G][U][A][A][U][mA][mU][C][A][U][mC][U][mA][G][U][mG][mU][mU] | 1054 | 1882 |

TABLE 5B-continued

| siRNAs for in vitro Screening‡ | | | | | | | | |
|---|---|---|---|---|---|---|---|---|
| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
| 1606 | siRNA279-M0 | [mA][mC][mU][mA][mG][mA][mU][mG][A][U][A][U][U][mA][mC][mA][mG][mG][A][mC][mA] | 671 | 1499 | [mU][G][U][mC][C][U][G][U][A][A][mU][mA][U][C][A][mU][C][mU][A][G][mU][mU][mU] | 1055 | 1883 |
| 1609 | siRNA280-M0 | [mA][mG][mA][mU][mG][mA][mU][mA][U][U][A][C][A][mG][mG][mA][mC][mU][G][mC][mA] | 672 | 1500 | [mU][G][C][mA][G][U][C][C][U][G][mU][mA][A][U][A][mU][C][mA][U][C][mU][mU][mU] | 1056 | 1884 |
| 1610 | siRNA281-M0 | [mG][mA][mU][mG][mA][mU][mA][mU][U][A][C][A][G][mG][mA][mC][mU][mG][C][mA][mA] | 673 | 1501 | [mU][U][G][mC][A][G][U][C][C][U][mG][mU][A][A][U][mA][U][mC][A][U][mC][mU][mU] | 1057 | 1885 |
| 1614 | siRNA282-M0 | [mA][mU][mA][mU][mU][mA][mC][mA][G][G][A][C][U][mG][mC][mA][mG][mA][A][mC][mA] | 674 | 1502 | [mU][G][U][mU][C][U][G][C][A][G][mU][mC][C][U][G][mU][A][mA][U][A][mU][mU][mU] | 1058 | 1886 |
| 1638 | siRNA283-M0 | [mU][mC][mA][mC][mC][mA][mC][mA][C][A][G][U][C][mC][mC][mU][mU][mU][G][mG][mA] | 675 | 1503 | [mU][C][C][mA][A][A][G][G][G][A][mC][mU][G][U][G][mU][G][mG][U][G][mA][mU][mU] | 1059 | 1887 |
| 1660 | siRNA284-M0 | [mA][mA][mA][mU][mG][mC][mA][mU][U][U][A][G][U][mG][mG][mU][mG][mG][U][mA][mA] | 676 | 1504 | [mU][U][A][mC][C][A][C][C][A][C][mU][mA][A][A][U][mG][C][mA][U][U][mU][mU][mU] | 1060 | 1888 |
| 1661 | siRNA285-M0 | [mA][mA][mU][mG][mC][mA][mU][mU][U][A][G][U][G][mG][mU][mG][mG][mU][A][mG][mA] | 677 | 1505 | [mU][C][U][mA][C][C][A][C][C][A][mC][mU][A][A][A][mU][G][mC][A][U][mU][mU][mU] | 1061 | 1889 |
| 1662 | siRNA286-M0 | [mA][mU][mG][mC][mA][mU][mU][mU][A][G][U][G][G][mU][mG][mG][mU][mA][G][mA][mA] | 678 | 1506 | [mU][U][C][mU][A][C][C][A][C][C][mA][mC][U][A][A][mA][U][mG][C][A][mU][mU][mU] | 1062 | 1890 |
| 1663 | siRNA287-M0 | [mU][mG][mC][mA][mU][mU][mU][mA][G][U][G][G][U][mG][mG][mU][mA][mG][A][mA][mA] | 679 | 1507 | [mU][U][U][mC][U][A][C][C][A][C][mC][mA][C][U][A][mA][A][mU][G][C][mA][mU][mU] | 1063 | 1891 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 1669 | siRNA288-M0 | [mU][mA][mG][mU][mG][mG][mU][mG][G][U][A][G][A][mA][mA][mU][mG][mA][U][mU][mA] | 680 | 1508 | [mU][A][A][mU][C][A][U][U][U][C][mU][mA][C][C][A][mC][C][mA][C][U][mA][mU][mU] | 1064 | 1892 |
| 1671 | siRNA289-M0 | [mG][mU][mG][mG][mU][mG][mG][mU][A][G][A][A][A][mU][mG][mA][mU][mU][C][mA][mA] | 681 | 1509 | [mU][U][G][mA][A][U][C][A][U][U][mU][mC][U][A][C][mC][A][mC][C][A][mC][mU][mU] | 1065 | 1893 |
| 1673 | siRNA290-M0 | [mG][mG][mU][mG][mG][mU][mA][mG][A][A][U][G][mA][mU][mU][mC][mA][C][mC][mA] | 682 | 1510 | [mU][G][G][mU][G][A][A][U][C][A][mU][mU][U][C][U][mA][C][mC][A][C][mC][mU][mU] | 1066 | 1894 |
| 1676 | siRNA291-M0 | [mG][mG][mU][mA][mG][mA][mA][mA][U][G][A][U][U][mC][mA][mC][mC][mA][G][mG][mA] | 683 | 1511 | [mU][C][C][mU][G][G][U][G][A][A][mU][mC][A][U][U][mU][C][mU][A][C][mC][mU][mU] | 1067 | 1895 |
| 1683 | siRNA292-M0 | [mA][mU][mG][mA][mU][mU][mC][mA][C][C][A][G][G][mU][mC][mC][mA][mA][U][mG][mA] | 684 | 1512 | [mU][C][A][mU][U][G][G][A][C][C][mU][mG][G][U][G][mA][A][mU][C][A][mU][mU][mU] | 1068 | 1896 |
| 1686 | siRNA293-M0 | [mA][mU][mU][mC][mA][mC][mC][mA][G][G][U][C][C][mA][mA][mU][mG][mU][U][mG][mA] | 685 | 1513 | [mU][C][A][mA][C][A][U][U][G][G][mA][mC][C][U][G][mG][U][mG][A][A][mU][mU][mU] | 1069 | 1897 |
| 1689 | siRNA294-M0 | [mC][mA][mC][mC][mA][mG][mG][mU][C][C][A][A][U][mG][mU][mU][mG][mU][U][mC][mA] | 686 | 1514 | [mU][G][A][mA][C][A][A][C][A][U][mU][mG][G][mU][G][A][mA][C][A][A][mG][mU][mU] | 1070 | 1898 |
| 1690 | siRNA295-M0 | [mA][mC][mC][mA][mG][mG][mU][mC][C][A][A][U][G][mU][mU][mG][mU][mU][C][mA][mA] | 687 | 1515 | [mU][U][G][mA][A][C][A][A][C][A][mU][mU][G][G][A][mC][C][mU][G][G][mU][mU][mU] | 1071 | 1899 |
| 1692 | siRNA296-M0 | [mC][mA][mG][mG][mU][mC][mC][mA][A][U][G][U][U][mG][mU][mU][mC][mA][C][mC][mA] | 688 | 1516 | [mU][G][G][mU][G][A][A][C][A][A][mC][mA][U][U][G][mG][A][mC][C][U][mG][mU][mU] | 1072 | 1900 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 1712 | siRNA297-M0 | [mA][mG][mU][mG][mC][mU][mU][mG][C][U][U][G][U][mG][mA][mA][mU][mC][U][mU][mA] | 689 | 1517 | [mU][A][A][mG][A][U][U][C][A][C][mA][mA][G][C][A][mA][G][mC][A][C][mU][mU][mU] | 1073 | 1901 |
| 1713 | siRNA298-M0 | [mG][mU][mG][mC][mU][mU][mG][mC][U][U][G][U][G][mA][mA][mU][C][mU][U][mA][mA] | 690 | 1518 | [mU][U][A][mA][G][A][U][U][C][A][mC][mA][A][G][C][mA][A][mG][C][A][mC][mU][mU] | 1074 | 1902 |
| 1769 | siRNA299-M0 | [mU][mC][mU][mG][mC][mU][mA][mG][U][G][A][A][A][mA][mG][mA][mA][mC][U][mA][mA] | 691 | 1519 | [mU][U][A][mG][U][U][C][U][U][U][mU][mC][A][C][U][mA][G][mC][A][G][mA][mU][mU] | 1075 | 1903 |
| 1770 | siRNA300-M0 | [mC][mU][mG][mC][mU][mA][mG][mU][G][A][A][A][A][mG][mA][mA][mC][mU][A][mG][mA] | 692 | 1520 | [mU][C][U][mA][G][U][U][C][U][U][mU][mU][C][A][C][mU][A][mG][C][A][mG][mU][mU] | 1076 | 1904 |
| 1824 | siRNA301-M0 | [mU][mA][mA][mG][mU][mC][mC][mA][U][G][A][A][U][mG][mU][mU][mC][mA][U][mA][mA] | 693 | 1521 | [mU][U][A][mU][G][A][A][C][A][U][mU][mC][A][U][G][mG][A][mC][U][U][mA][mU][mU | 1077 | 1905 |
| 1825 | siRNA302-M0 | [mA][mA][mG][mU][mC][mC][mA][mU][G][A][A][U][G][mU][mU][mC][mA][mU][A][mU][mA] | 694 | 1522 | [mU][A][U][mA][U][G][A][A][C][A][mU][mU][C][A][U][mG][G][mA][C][U][mU][mU][mU] | 1078 | 1906 |
| 1826 | siRNA303-M0 | [mA][mG][mU][mC][mC][mA][mU][mG][A][A][U][G][U][mU][mC][mA][mU][mA][U][mA][mA] | 695 | 1523 | [mU][U][A][mU][A][U][G][A][A][C][mA][mU][U][C][A][mU][G][mG][A][C][mU][mU][mU] | 1079 | 1907 |
| 1827 | siRNA304-M0 | [mG][mU][mC][mC][mA][mU][mG][mA][A][U][G][U][U][mC][mA][mU][mA][mU][A][mG][mA] | 696 | 1524 | [mU][C][U][mA][U][A][U][G][A][A][mC][mA][U][U][C][mA][U][mG][G][A][mC][mU][mU] | 1080 | 1908 |
| 1828 | siRNA305-M0 | [mU][mC][mC][mA][mU][mG][mA][mA][U][G][U][U][C][mA][mU][mA][mU][mA][G][mC][mA] | 697 | 1525 | [mU][G][C][mU][A][U][A][U][G][A][mA][mC][A][U][U][mC][A][mU][G][G][mA][mU][mU] | 1081 | 1909 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 1829 | siRNA306-M0 | [mC][mC][mA][mU][mG][mA][mA][mU][G][U][U][C][A][m][mA][mU][mA][mG][C][mC][mA] | 698 | 1526 | [mU][G][G][mC][U][A][U][A][U][G][mA][mA][C][A][U][mU][C][mA][U][G][mG][mU][mU] | 1082 | 1910 |
| 1830 | siRNA307-M0 | [mC][mA][mU][mG][mA][mA][mU][mG][U][U][C][A][U][mA][mU][mA][mG][mC][C][mA][mA] | 699 | 1527 | [mU][U][G][mG][C][U][A][U][A][U][mG][mA][A][C][A][mU][U][mC][A][U][mG][mU][mU] | 1083 | 1911 |
| 1895 | siRNA308-M0 | [mU][mU][mU][mU][mU][mU][mU][mC][A][A][A][U][mG][mA][mA][mG][mA][U][mA][mA] | 700 | 1528 | [mU][U][A][mU][C][U][U][C][A][U][mU][mU][U][G][A][mA][A][mA][A][A][mA][mU][mU] | 1084 | 1912 |
| 2052 | siRNA309-M0 | [mU][mG][mU][mA][mU][mU][mC][mU][A][A][U][U][G][mG][mC][mA][mG][mA][U][mU][mA] | 701 | 1529 | [mU][A][A][mU][C][U][G][C][C][A][mA][mU][U][A][G][mA][A][mU][A][C][mA][mU][mU] | 1085 | 1913 |
| 2053 | siRNA310-M0 | [mG][mU][mA][mU][mU][mC][mU][mA][A][U][U][G][G][mC][mA][mG][mA][mU][U][mG][mA] | 702 | 1530 | [mU][C][A][mA][U][C][U][G][C][C][mA][mA][U][U][A][mG][A][mA][U][A][mC][mU][mU] | 1086 | 1914 |
| 2075 | siRNA311-M0 | [mU][mU][mU][mU][mC][mC][mU][mA][A][G][G][A][A][mA][mC][mU][mG][mC][U][mU][mA] | 703 | 1531 | [mU][A][A][mG][C][A][G][U][U][U][mC][mC][U][U][A][mG][G][mA][A][A][mA][mU][mU] | 1087 | 1915 |
| 2127 | siRNA312-M0 | [mA][mA][mA][mU][mG][mU][mU][mC][A][A][A][U][U][mC][mA][mC][mG][mU][U][mC][mA] | 704 | 1532 | [mU][G][A][mA][C][G][U][G][A][A][mU][mU][U][G][A][mA][C][mA][U][U][mU][mU][mU] | 1088 | 1916 |
| 2128 | siRNA313-M0 | [mA][mA][mU][mG][mU][mU][mC][mA][A][A][U][U][C][mA][mC][mG][mU][mU][C][mU][mA] | 705 | 1533 | [mU][A][G][mA][A][C][G][U][G][A][mA][mU][U][U][G][mA][A][mC][A][U][mU][mU][mU] | 1089 | 1917 |
| 2132 | siRNA314-M0 | [mU][mU][mC][mA][mA][mA][mU][mU][C][A][C][G][U][mU][mC][mU][mA][mG][U][mG][mA] | 706 | 1534 | [mU][C][A][mC][U][A][G][A][A][C][mG][mU][G][A][A][mU][U][mU][G][A][mA][mU][mU] | 1090 | 1918 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 2133 | siRNA315-M0 | [m][mC][mA][mA][mA][mU][mU][mC][A][C][G][U][U][mC][mU][mA][mG][mU][G][mA][mA] | 707 | 1535 | [mU][U][C][mA][C][U][A][G][A][A][mC][mG][U][G][A][mA][U][mU][U][G][mA][mU][mU] | 1091 | 1919 |
| 2134 | siRNA316-M0 | [mC][mA][mA][mA][mU][mU][mC][mA][C][G][U][U][C][mU][mA][mG][mU][mG][A][mA][mA] | 708 | 1536 | [mU][U][U][mC][A][C][U][A][G][A][mA][mC][G][U][G][mA][A][mU][U][U][mG][mU][mU] | 1092 | 1920 |
| 2135 | siRNA317-M0 | [mA][mA][mA][mU][mU][mC][mA][mC][G][U][U][C][U][mA][mG][mU][mG][mA][A][mA][mA] | 709 | 1537 | [mU][U][U][mU][C][A][C][U][A][G][mA][mA][C][G][U][mG][A][mA][U][U][mU][mU][mU] | 1093 | 1921 |
| 2136 | siRNA318-M0 | [mA][mA][mU][mU][mC][mA][mC][mG][U][U][C][U][A][mG][mU][mG][mA][mA][A][mC][mA] | 710 | 1538 | [mU][G][U][mU][U][C][A][C][U][A][mG][mA][A][C][G][mU][G][mA][A][U][mU][mU][mU] | 1094 | 1922 |
| 2137 | siRNA319-M0 | [mA][mU][mU][mC][mA][mC][mG][mU][U][C][U][A][G][m][mG][mA][mA][mA][C][mU][mA] | 711 | 1539 | [mU][A][G][mU][U][U][C][A][C][U][mA][mG][A][A][C][mG][U][mG][A][A][mU][mU][mU] | 1095 | 1923 |
| 2139 | siRNA320-M0 | [m][mC][mA][mC][mG][mU][mU][mC][U][A][G][U][G][mA][mA][mA][mC][mU][G][mC][mA] | 712 | 1540 | [mU][G][C][mA][G][U][U][U][C][A][mC][mU][A][G][A][mA][C][mG][U][G][mA][mU][mU] | 1096 | 1924 |
| 2140 | siRNA321-M0 | [mC][mA][mC][mG][mU][mU][mC][mU][A][G][U][G][A][mA][mA][mC][mU][mG][C][mA][mA] | 713 | 1541 | [mU][U][G][mC][A][G][U][U][U][C][mA][mC][U][A][G][mA][A][mC][G][U][mG][mU][mU] | 1097 | 1925 |
| 2144 | siRNA322-M0 | [mU][mU][mC][mU][mA][mG][mU][mG][A][A][A][C][U][mG][mC][mA][mU][mU][A][mU][mA] | 714 | 1542 | [mU][A][U][mA][A][U][G][C][A][G][mU][mU][U][C][A][mC][U][mA][G][A][mA][mU][mU] | 1098 | 1926 |
| 2189 | siRNA323-M0 | [mC][mG][mG][mG][mU][mG][mU][mG][A][U][C][A][U][mA][mU][mA][mU][mC][A][mU][mA] | 715 | 1543 | [mU][A][U][mG][A][U][A][U][A][U][mG][mA][U][C][A][mC][A][mC][C][C][mG][mU][mU] | 1099 | 1927 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 2190 | siRNA324-M0 | [mG][mG][mG][mU][mG][mU][mG][mA][U][C][A][U][A][mU][mA][mU][mC][mA][U][mA][mA] | 716 | 1544 | [mU][U][A][mU][G][A][U][A][U][A][mU][mG][A][U][C][mA][C][mA][C][C][mC][mU][mU] | 1100 | 1928 |
| 2191 | siRNA325-M0 | [mG][mG][mU][mG][mU][mG][mA][mU][C][A][U][A][U][mA][mU][mC][mA][mU][A][mA][mA] | 717 | 1545 | [mU][U][U][mA][U][G][A][U][A][U][mA][mU][G][A][U][mC][A][mC][A][C][mC][mU][mU] | 1101 | 1929 |
| 2192 | siRNA326-M0 | [mG][mU][mG][mU][mG][mA][mU][mC][A][U][A][U][A][mU][mC][mA][mU][mA][A][mA][mA] | 718 | 1546 | [mU][U][U][mU][A][U][G][A][U][A][mU][mA][U][G][A][mU][C][mA][C][A][mC][mU][mU] | 1102 | 1930 |
| 2193 | siRNA327-M0 | [mU][mG][mU][mG][mA][mU][mC][mA][U][A][U][A][U][mC][mA][mU][mA][mA][A][mG][mA] | 719 | 1547 | [mU][C][U][mU][U][A][U][G][A][U][mA][mU][A][U][G][mA][U][mC][A][C][mA][mU][mU] | 1103 | 1931 |
| 2194 | siRNA328-M0 | [mG][mU][mG][mA][mU][mC][mA][mU][A][U][A][U][C][mA][mU][mA][mA][mA][G][mG][mA] | 720 | 1548 | [mU][C][C][mU][U][U][A][U][G][A][mU][mA][U][A][U][mG][A][mU][C][A][mC][mU][mU] | 1104 | 1932 |
| 2195 | siRNA329-M0 | [mU][mG][mA][mU][mC][mA][mU][mA][U][A][U][C][A][mU][mA][mA][mA][mG][G][mA][mA] | 721 | 1549 | [mU][U][C][mC][U][U][U][A][U][G][mA][mU][A][U][A][mU][G][mA][U][C][mA][mU][mU] | 1105 | 1933 |
| 2199 | siRNA330-M0 | [mC][mA][mU][mA][mU][mA][mU][mC][A][U][A][A][A][mG][mG][mA][mU][mA][U][mU][mA] | 722 | 1550 | [mU][A][A][mU][A][U][C][C][U][U][mU][mA][U][G][A][mU][A][mU][A][U][mG][mU][mU] | 1106 | 1934 |
| 2209 | siRNA331-M0 | [mA][mA][mA][mG][mG][mA][mU][mA][U][U][U][C][A][mA][mA][mU][mG][mA][U][mU][mA] | 723 | 1551 | [mU][A][A][mU][C][A][U][U][U][G][mA][mA][A][U][A][mU][C][mC][U][U][mU][mU][mU] | 1107 | 1935 |
| 2210 | siRNA332-M0 | [mA][mA][mG][mG][mA][mU][mA][mU][U][U][C][A][A][mA][mU][mG][mA][mU][U][mA][mA] | 724 | 1552 | [mU][U][A][mA][U][C][A][U][U][U][mG][mA][A][A][U][mA][U][mC][C][U][mU][mU][mU] | 1108 | 1936 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 2211 | siRNA333-M0 | [mA][mG][mG][mA][mU][mA][mU][mU][U][C][A][A][A][mU][mG][mA][mU][mU][A][mU][mA] | 725 | 1553 | [mU][A][U][mA][A][U][C][A][U][U][mU][mG][A][A][A][mU][A][mU][C][C][mU][mU][mU] | 1109 | 1937 |
| 2215 | siRNA334-M0 | [mU][mA][mU][mU][mU][mC][mA][mA][A][U][G][A][U][mU][mA][mU][mG][mA][U][mU][mA] | 726 | 1554 | [mU][A][A][mU][C][A][U][A][A][U][mC][mA][U][U][U][mG][A][mA][A][U][mA][mU][mU] | 1110 | 1938 |
| 2216 | siRNA335-M0 | [mA][mU][mU][mU][mC][mA][mA][mA][U][G][A][U][U][mA][mU][mG][mA][mU][U][mA][mA] | 727 | 1555 | [mU][U][A][mA][U][C][A][U][A][A][mU][mC][A][U][U][mU][G][mA][A][A][mU][mU][mU] | 1111 | 1939 |
| 2217 | siRNA336-M0 | [mU][mU][mU][mC][mA][mA][mA][mU][G][A][U][U][A][mU][mG][mA][mU][mU][A][mG][mA] | 728 | 1556 | [mU][C][U][mA][A][U][C][A][U][A][mA][mU][C][A][U][mU][U][mG][A][A][mA][mU][mU] | 1112 | 1940 |
| 2218 | siRNA337-M0 | [mU][mU][mC][mA][mA][mA][mU][mG][A][U][U][A][U][mG][mA][mU][mU][mA][G][mU][mA] | 729 | 1557 | [mU][A][C][mU][A][A][U][C][A][U][mA][mA][U][C][A][mU][U][mU][G][A][mA][mU][mU] | 1113 | 1941 |
| 2220 | siRNA338-M0 | [mC][mA][mA][mA][mU][mG][mA][mU][U][A][U][G][A][mU][mU][mA][mG][mU][U][mA][mA] | 730 | 1558 | [mU][U][A][mA][C][U][A][A][U][C][mA][mU][A][A][U][C][mA][mU][A][[mG][mU][mU] | 1114 | 1942 |
| 2221 | siRNA339-M0 | [mA][mA][mA][mU][mG][mA][mU][mU][A][U][G][A][U][mU][mA][mG][mU][mU][A][mU][mA] | 731 | 1559 | [mU][A][U][mA][A][C][U][A][A][U][mC][mA][U][A][A][mU][C][mA][U][U][mU][mU][mU] | 1115 | 1943 |
| 2223 | siRNA340-M0 | [mA][mU][mG][mA][mU][mU][mA][mU][G][A][U][U][A][mG][mU][mU][mA][mU][G][mU][mA] | 732 | 1560 | [mU][A][C][mA][U][A][A][C][U][A][mA][mU][C][A][U][mA][A][mU][C][A][mU][mU][mU] | 1116 | 1944 |
| 2224 | siRNA341-M0 | [mU][mG][mA][mU][mU][mA][mU][mG][A][U][U][A][G][mU][mU][mA][mU][mG][U][mC][mA] | 733 | 1561 | [mU][G][A][mC][A][U][A][A][C][U][mA][mA][U][C][A][mU][A][mA][U][C][mA][mU][mU] | 1117 | 1945 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 2225 | siRNA342-M0 | [mG][mA][mU][mU][mA][mU][mG][mA][U][U][A][G][U][mU][mA][mU][mG][mU][C][mU][mA] | 734 | 1562 | [mU][A][G][mA][C][A][U][A][A][C][mU][mA][A][U][C][mA][U][mA][A][U][mC][mU][mU] | 1118 | 1946 |
| 2313 | siRNA343-M0 | [mU][mU][mG][mA][mU][mU][mU][mC][C][C][A][A][A][mA][mA][mC][mA][mC][U][mA][mA] | 735 | 1563 | [mU][U][A][mG][U][G][U][U][U][U][mU][mG][G][G][A][mA][A][mU][C][A][mA][mU][mU] | 1119 | 1947 |
| 2316 | siRNA344-M0 | [mA][mU][mU][mU][mC][mC][mC][mA][A][A][A][C][mA][mC][mU][mA][mA][A][mG][mA] | 736 | 1564 | [mU][C][U][mU][U][A][G][U][G][U][mU][mU][U][U][G][mG][G][mA][A][A][mU][mU][mU] | 1120 | 1948 |
| 2317 | siRNA345-M0 | [mU][mU][mU][mC][mC][mC][mA][mA][A][A][C][A][mC][mU][mA][mA][mA][G][mG][mA] | 737 | 1565 | [mU][C][C][mU][U][U][A][G][U][G][mU][mU][U][U][U][mG][G][mG][A][A][mA][mU][mU] | 1121 | 1949 |
| 2319 | siRNA346-M0 | [mU][mC][mC][mC][mA][mA][mA][mA][A][C][A][C][U][mA][mA][mA][mG][mG][U][mG][mA] | 738 | 1566 | [mU][C][A][mC][C][U][U][U][A][G][mU][mG][U][U][U][mU][U][mG][G][G][mA][mU][mU] | 1122 | 1950 |
| 2320 | siRNA347-M0 | [mC][mC][mC][mA][mA][mA][mA][mA][C][A][C][U][A][mA][mA][mG][mG][mU][G][mG][mA] | 739 | 1567 | [mU][C][C][mA][C][C][U][U][U][A][mG][mU][G][U][U][mU][U][mU][G][G][mG][mU][mU] | 1123 | 1951 |
| 2321 | siRNA348-M0 | [mC][mC][mA][mA][mA][mA][mA][mC][A][C][U][A][A][mA][mG][mG][mU][mG][G][mU][mA | 740 | 1568 | [mU][A][C][C][A][C][C][U][U][U][mA][mG][U][G][U][mU][U][mU][U][G][mG][mU][mU] | 1124 | 1952 |
| 2353 | siRNA349-M0 | [mU][mC][mA][mU][mG][mU][mU][mU][U][A][A][C][U][mU][mA][mU][mU][mG][U][mU][mA] | 741 | 1569 | [mU][A][A][mC][A][A][U][A][A][G][mU][mU][A][A][A][mA][C][mA][U][G][mA][mU][mU] | 1125 | 1953 |
| 2355 | siRNA350-M0 | [mA][mU][mG][mU][mU][mU][mU][mA][A][C][U][U][A][mU][mU][mG][mU][mU][G][mC][mA] | 742 | 1570 | [mU][G][C][mA][A][C][A][A][U][A][mA][mG][U][U][A][mA][A][mA][C][A][mU][mU][mU] | 1126 | 1954 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 2356 | siRNA351-M0 | [mU][mG][mU][mU][mU][mU][mA][mA][C][U][U][A][U][mU][mG][mU][mU][mG][C][mU][mA] | 743 | 1571 | [mU][A][G][mC][A][A][C][A][A][U][mA][mA][G][U][U][mA][A][mA][A][C][mA][mU][mU] | 1127 | 1955 |
| 2362 | siRNA352-M0 | [mA][mA][mC][mU][mU][mA][mU][mU][G][U][U][G][C][mU][mG][mA][mA][mA][A][mC][mA] | 744 | 1572 | [mU][G][U][mU][U][U][C][A][G][C][mA][mA][C][A][A][mU][A][mA][G][U][mU][mU][mU] | 1128 | 1956 |
| 2364 | siRNA353-M0 | [mC][mU][mU][mA][mU][mU][mG][mU][U][G][C][U][G][mA][mA][mA][mA][mC][U][mC][mA] | 745 | 1573 | [mU][G][A][mG][U][U][U][U][C][A][mG][mC][A][A][C][mA][A][mU][A][A][mG][mU][mU] | 1129 | 1957 |
| 2365 | siRNA354-M0 | [mU][mU][mA][mU][mU][mG][mU][mU][G][C][U][G][A][mA][mA][mA][mC][mU][C][mU][mA] | 746 | 1574 | [mU][A][G][mA][G][U][U][U][U][C][mA][mG][C][A][A][mC][A][mA][U][A][mA][mU][mU] | 1130 | 1958 |
| 2366 | siRNA355-M0 | [mU][mA][mU][mU][mG][mU][mU][mG][C][U][G][A][A][mA][mA][mC][mU][mC][U][mA][mA] | 747 | 1575 | [mU][U][A][mG][A][G][U][U][U][U][mC][mA][G][C][A][mA][C][mA][A][U][mA][mU][mU] | 1131 | 1959 |
| 2370 | siRNA356-M0 | [mG][mU][mU][mG][mC][mU][mG][mA][A][A][A][C][U][mC][mU][mA][mU][mG][U][mC][mA] | 748 | 1576 | [mU][G][A][mC][A][U][A][G][A][G][mU][mU][U][U][C][mA][G][mC][A][A][mC][mU][mU] | 1132 | 1960 |
| 2503 | siRNA357-M0 | [mA][mA][mA][mA][mA][mU][mG][mU][A][G][C][U][U][mU][mU][mA][mU][mG][U][mG][mA] | 749 | 1577 | [mU][C][A][mC][A][U][A][A][A][A][mG][mC][U][A][C][mA][U][mU][U][U][mU][mU][mU] | 1133 | 1961 |
| 2562 | siRNA358-M0 | [mG][mG][mA][mA][mG][mC][mU][mU][U][G][G][U][U][mA][mU][mG][mA][mA][A][mC][mA] | 750 | 1578 | [mU][G][U][mU][U][C][A][U][A][A][mC][mC][A][A][A][mAG][C][mU][U][C][mC][mU][mU] | 1134 | 1962 |
| 2563 | siRNA359-M0 | [mG][mA][mA][mG][mC][mU][mU][mU][G][G][U][U][A][mU][mG][mA][mA][mA][C][mA][mA] | 751 | 1579 | [mU][U][G][mU][U][U][C][A][U][A][mA][mC][C][A][A][mA][G][mC][U][U][mC][mU][mU] | 1135 | 1963 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 2620 | siRNA360-M0 | [mA][mU][mU][mU][mA][mA][mA][mU][G][C][U][U][U][mU][mU][mA][mU][mC][G][mC][mA] | 752 | 1580 | [mU][G][C][mG][A][U][A][A][A][A][mA][mG][C][A][U][mU][U][mA][A][A][mU][mU][mU] | 1136 | 1964 |
| 2621 | siRNA361-M0 | [mU][mU][mU][mA][mA][mA][mU][mG][C][U][U][U][U][mU][mA][mU][mC][mG][C][mU][mA] | 753 | 1581 | [mU][A][G][mC][G][A][U][A][A][A][mA][mA][G][C][A][mU][U][mU][A][A][mA][mU][mU] | 1137 | 1965 |
| 2622 | siRNA362-M0 | [mU][mU][mA][mA][mA][mU][mG][mC][U][U][U][U][U][mA][mU][mC][mG][mC][U][mA][mA] | 754 | 1582 | [mU][U][A][mG][C][G][A][U][A][A][mA][mA][A][G][C][mA][U][mU][U][A][mA][mU][mU] | 1138 | 1966 |
| 2623 | siRNA363-M0 | [mU][mA][mA][mA][mU][mG][mC][mU][U][U][U][U][A][mU][mC][mG][mC][mU][A][mA][mA] | 755 | 1583 | [mU][U][U][mA][G][C][G][A][A][A][mA][mA][A][A][G][mC][A][mU][U][U][mA][mU][mU] | 1139 | 1967 |
| 2624 | siRNA364-M0 | [mA][mA][mA][mU][mG][mC][mU][mU][U][U][U][A][U][mC][mG][mC][mU][mA][A][mA][mA] | 756 | 1584 | [mU][U][U][mU][A][G][C][G][A][U][mA][mA][A][A][A][mG][C][mA][U][U][mU][mU][mU] | 1140 | 1968 |
| 2625 | siRNA365-M0 | [mA][mA][mU][mG][mC][mU][mU][mU][U][U][A][U][C][mG][mC][mU][mA][mA][A][mU][mA] | 757 | 1585 | [mU][A][U][mU][U][A][G][C][G][A][mU][mA][A][A][A][mA][G][mC][A][U][mU][mU][mU] | 1141 | 1969 |
| 2629 | siRNA366-M0 | [mC][mU][mU][mU][mU][mU][mA][mU][C][G][C][U][A][mA][mA][mU][mG][mA][C][mU][mA | 758 | 1586 | [mU][A][G][mU][C][A][U][U][U][A][mG][mC][G][A][U][mA][A][mA][A][A][mG][mU][mU] | 1142 | 1970 |
| 2630 | siRNA367-M0 | [mU][mU][mU][mU][mU][mA][mU][mC][G][C][U][A][A][mA][mU][mG][mA][mC][U][mU][mA] | 759 | 1587 | [mU][A][A][mG][U][C][A][U][U][U][mA][mG][C][G][A][mU][A][mA][A][A][mA][mU][mU] | 1143 | 1971 |
| 2632 | siRNA368-M0 | [mU][mU][mU][mA][mU][mC][mG][mC][U][A][A][A][U][mG][mA][mC][mU][mU][G][mC][mA] | 760 | 1588 | [mU][G][C][mA][A][G][U][C][A][U][mU][mU][A][G][C][mG][A][mU][A][A][mA][mU][mU] | 1144 | 1972 |

TABLE 5B-continued siRNAs for in vitro Screening‡

| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
|---|---|---|---|---|---|---|---|
| 2633 | siRNA369-M0 | [mU][mU][mA][mU][mC][mG][mC][mU][A][A][A][U][G][mA][mC][mU][mU][mG][C][mA][mA] | 761 | 1589 | [mU][U][G][mC][A][A][G][U][C][A][mU][mU][U][A][G][mC][G][mA][U][A][mA][mU][mU] | 1145 | 1973 |
| 2635 | siRNA370-M0 | [mA][mU][mC][mG][mC][mU][mA][mA][A][U][G][A][C][mU][mU][mG][mC][mA][G][mA][mA] | 762 | 1590 | [mU][U][C][mU][G][C][A][A][G][U][mC][mA][U][U][U][mA][G][mC][G][A][mU][mU][mU] | 1146 | 1974 |
| 2639 | siRNA371-M0 | [mC][mU][mA][mA][mA][mU][mG][mA][C][U][U][G][C][mA][mG][mA][mU][mG][A][mA][mA] | 763 | 1591 | [mU][U][U][mC][A][U][C][U][G][C][mA][mA][G][U][C][mA][U][mU][U][A][mG][mU][mU] | 1147 | 1975 |
| 2679 | siRNA372-M0 | [mU][mG][mU][mU][mU][mA][mA][mA][U][G][C][U][G][mU][mG][mU][mA][mC][A][mA][mA] | 764 | 1592 | [mU][U][U][mG][U][A][C][A][C][A][mG][mC][A][U][U][mU][A][mA][A][C][mA][mU][mU] | 1148 | 1976 |
| 2682 | siRNA373-M0 | [mU][mU][mA][mA][mA][mU][mG][mC][U][G][U][G][U][mA][mC][mA][mA][mC][A][mA][mA | 765 | 1593 | [mU][U][U][mG][U][U][G][U][A][C][mA][mC][A][G][C][mA][U][mU][U][A][mA][mU][mU] | 1149 | 1977 |
| 2683 | siRNA374-M0 | [[mU][mA][mA][mA][mU][mG][mC][mU][G][U][G][U][A][mC][mA][mA][mC][mA][A][mU][mA] | 766 | 1594 | [mU][A][U][mU][G][U][U][G][U][A][mC][mA][C][A][G][mC][A][mU][U][U][mA][mU][mU] | 1150 | 1978 |
| 2687 | siRNA375-M0 | [mU][mG][mC][mU][mG][mU][mG][mU][A][C][A][A][C][mA][mA][mU][mG][mC][U][mU][mA] | 767 | 1595 | [mU][A][A][mG][C][A][U][U][G][U][mU][mG][U][A][C][mA][C][mA][G][C][mA][mU][mU] | 1151 | 1979 |
| 2690 | siRNA376-M0 | [mU][mG][mU][mG][mU][mA][mC][mA][A][C][A][A][U][mG][mC][mU][mU][mU][G][mA][mA] | 768 | 1596 | [mU][U][C][mA][A][A][G][C][A][U][mU][mG][U][U][G][mU][A][mC][A][C][mA][mU][mU] | 1152 | 1980 |
| 2691 | siRNA377-M0 | [mG][mU][mG][mU][mA][mC][mA][mA][C][A][A][U][G][mC][mU][mU][mU][mG][A][mU][mA] | 769 | 1597 | [mU][A][U][mC][A][A][A][G][C][A][mU][mU][G][U][U][mG][U][mA][C][A][mC][mU][mU] | 1153 | 1981 |

TABLE 5B-continued

| siRNAs for in vitro Screening‡ | | | | | | | |
|---|---|---|---|---|---|---|---|
| Position | siRNA#* | Sense (5'-3') | Nucleobase SEQ ID NO: | SEQ ID NO of modified sense strand: | Antisense (5'-3') | Nucleobase SEQ ID NO: | SEQ ID NO of modified antisense strand: |
| 2692 | siRNA378-M0 | [mU][mG][mU][mA][mC][mA][mA][mC][A][A][U][G][C][mU][mU][mU][mG][mA][U][mA][mA] | 770 | 1598 | [mU][U][A][mU][C][A][A][A][G][C][mA][mU][U][G][U][mU][G][mU][A][C][mA][mU][mU] | 1154 | 1982 |
| 2833 | siRNA379-M0 | [mG][mA][mU][mA][mA][mU][mU][mU][U][G][A][A][A][mU][mG][mA][mU][mU][C][mA][mA] | 771 | 1599 | [mU][U][G][mA][A][U][C][A][U][U][mU][mC][A][A][A][mA][U][mU][A][U][mC][mU][mU] | 1155 | 1983 |
| 2834 | siRNA380-M0 | [mA][mU][mA][mA][mU][mU][mU][mU][G][A][A][A][U][mG][mA][mU][mU][mC][A][mU][mA] | 772 | 1600 | [mU][A][U][mG][A][A][U][C][A][U][mU][mU][C][A][A][mA][A][mU][U][A][mU][mU][mU] | 1156 | 1984 |
| 2835 | siRNA381-M0 | [mU][mA][mA][mU][mU][mU][mU][mG][A][A][A][U][G][mA][mU][mU][mC][mA][U][mC][mA] | 773 | 1601 | [mU][G][A][mU][G][A][A][U][C][A][mU][mU][U][C][A][mA][A][mA][U][U][mA][mU][mU] | 1157 | 1985 |
| 2838 | siRNA382-M0 | [mU][mU][mU][mU][mG][mA][mA][mA][U][G][A][U][U][mC][mA][mU][mC][mU][U][mU][mA] | 774 | 1602 | [mU][A][A][mA][G][A][U][G][A][A][mU][mC][A][U][U][mU][C][mA][A][A][mA][mU][mU] | 1158 | 1986 |
| 2839 | siRNA383-M0 | [mU][mU][mU][mG][mA][mA][mA][mU][G][A][U][U][C][mA][mU][mC][mU][mU][U][mC][mA] | 775 | 1603 | [mU][G][A][mA][A][G][A][U][G][A][mA][mU][C][A][U][mU][U][mC][A][A][mA][mU][mU] | 1159 | 1987 |
| 2858 | siRNA384-M0 | [mC][mA][mG][mA][mA][mA][mU][mA][A][A][A][G][U][mA][mU][mG][mA][mA][U][mC][mA] | 776 | 1604 | [mU][G][A][mU][U][C][A][U][A][C][mU][mU][U][U][A][mU][U][mU][C][U][mG][mU][mU] | 1160 | 1988 |

*siRNA# in Table 5B correspond to the siRNA# in Table 5A, but with "M0" added to indicate modification pattern. M0 refers to the modification pattern of the siRNAs in Table 5B. In the sense strands, the nucleosides at positions 9-13 and 19 are ribonucleosides and the nucleosides at the rest of the positions are 2'-O-Me modified nucleosides. In the antisense strands, the nucleosides at positions 2, 3, 5-10, 13-15, 17, 19, and 20 are 2'-hydroxy nucleosides and the nucleosides at the rest of the positions are 2'-O-Me modified nucleosides.

‡Each uracil base (U) in any one of the sequences provided in Table 5B may independently and optionally be replaced with a thymine base (T).

Example 3: In Vitro Screening of siRNA Agents

Initially, a library of 384 siRNAs as listed in Table 5B with the generic 21/23-mer partially modified design were prioritized for synthesis for a primary in-vitro screen. For this initial set of constructs, a combination of 2'-OH (RNA) and 2'O-Me RNA nucleosides were used. The chosen modification pattern is minimally modified and is expected to maintain the intrinsic potency of a given siRNA sequence.

To determine knockdown efficiency of the synthesized siRNAs, a stable cell line overexpressing human CYP7A1 was generated. The whole library was then tested for their mRNA knockdown efficiency in vitro under transfection conditions. Two different concentrations (0.1 nM and 1 nM) were tested and siRNA that achieved 50%, or greater knockdown at the lowest concentration were selected.

Generation of CYP7A1 Over-Expressing Cells

U2OS cells were obtained from ATCC (Manassas, VA). Cells were thawed and sub-cultured according to manufacturer's recommendations. A stable over-expressing CYP7A11 U2OS cell line was generated by cloning hCyp7a1 DNA into a lentivirus expression vector and then co-transfecting along with lentivirus packaging plasmids into U2OS cells. After several weeks of growth under antibiotic selection, a stable pool was identified and expanded after evaluating mRNA expression of CYP7A1 by RT-PCR.

In Vitro RNAi Activity Procedure

U2OS cells overexpressing CYP7A1 mRNA were plated in a 96-well plate at 10,000 cells/well containing antibiotic-free medium and placed at 37° C. in an atmosphere with 5% CO2 in a humidified incubator. Within 24 hours after seeding, cells were transfected with biological duplicates for each treatment. Two concentrations (1 nM and 0.1 nM) of cyp7a1 siRNA as well as control siRNAs (ON-TARGETplus Human CYP7A1 control pool, Horizon Discovery) were applied to the cells following the manufacturer's recommendation (Thermofisher) for Lipofectamine RNAiMax. Cells were returned to the incubator for 24 hours. Cell lysates were prepared 24 hour post-transfection by removing medium and washing with cold PBS and the addition of lysis buffer (following the manufacturer's recommendation for Cells-to-CT 1-step TaqMan Kit, Thermofisher). Reverse transcription was performed on cell lysates which were then used for qPCR. qPCR was performed in duplicate for each sample in a 10 ul reaction mix, multiplexing the probe for CYP7A1 with the housekeeping gene probe (GAPDH): Nuclease-free water 5.5 ul+qRT-PCR Master Mix 2.5 ul+TaqMan Primer-1, 0.5 ul+TaqMan Primer-2, 0.5 ul.

For each well, the target mRNA level was normalized to the respective GAPDH mRNA level. The activity of a given siRNA was expressed as percent mRNA concentration of the respective target (normalized to GAPDH mRNA) in treated cells, relative to the target mRNA concentration (normalized to GAPDH mRNA) averaged across mock control wells. Table 6 summarizes the in vitro screening results.

TABLE 6

In vitro Screening of siRNAs

| Start_19mer | siRNA#* | % mRNA remaining_1 nM | KD_1 nM | % mRNA remaining_0.1 nM | KD_0.1 nM |
|---|---|---|---|---|---|
| 34 | siRNA1-M0 | 97.0 | 3.0 | 91.3 | 8.7 |
| 40 | siRNA2-M0 | 95.3 | 4.7 | 79.0 | 21.0 |
| 41 | siRNA3-M0 | 84.4 | 15.6 | 81.5 | 18.5 |
| 42 | siRNA4-M0 | 87.3 | 12.7 | 78.3 | 21.7 |
| 43 | siRNA5-M0 | 86.1 | 13.9 | 83.0 | 17.0 |
| 45 | siRNA6-M0 | 90.0 | 10.0 | 75.8 | 24.2 |
| 105 | siRNA7-M0 | 48.9 | 51.1 | 87.9 | 12.1 |
| 110 | siRNA8-M0 | 46.6 | 53.4 | 81.8 | 18.2 |
| 111 | siRNA9-M0 | 40.5 | 59.5 | 80.8 | 19.2 |
| 112 | siRNA10-M0 | 21.6 | 78.4 | 73.6 | 26.4 |
| 113 | siRNA11-M0 | 86.5 | 13.5 | 89.0 | 11.0 |
| 115 | siRNA12-M0 | 14.3 | 85.7 | 48.6 | 51.4 |
| 116 | siRNA13-M0 | 33.1 | 66.9 | 70.6 | 29.4 |
| 117 | siRNA14-M0 | 80.2 | 19.8 | 91.2 | 8.8 |
| 118 | siRNA15-M0 | 31.4 | 68.6 | 55.5 | 44.5 |
| 139 | siRNA16-M0 | 53.3 | 46.7 | 100.7 | −0.7 |
| 141 | siRNA17-M0 | 55.4 | 44.6 | 88.7 | 11.3 |
| 142 | siRNA18-M0 | 57.4 | 42.6 | 81.1 | 18.9 |
| 143 | siRNA19-M0 | 34.1 | 65.9 | 69.3 | 30.7 |
| 181 | siRNA20-M0 | 54.3 | 45.7 | 96.6 | 3.4 |
| 182 | siRNA21-M0 | 63.2 | 36.8 | 85.8 | 14.2 |
| 183 | siRNA22-M0 | 68.6 | 31.4 | 94.7 | 5.3 |
| 201 | siRNA23-M0 | 29.0 | 71.0 | 73.8 | 26.2 |
| 203 | siRNA24-M0 | 28.3 | 71.7 | 66.3 | 33.7 |
| 210 | siRNA25-M0 | 99.2 | 0.8 | 96.1 | 3.9 |
| 214 | siRNA26-M0 | 41.0 | 59.0 | 55.5 | 44.5 |
| 223 | siRNA27-M0 | 18.3 | 81.7 | 18.0 | 82.0 |
| 225 | siRNA28-M0 | 81.2 | 18.8 | 84.3 | 15.7 |
| 229 | siRNA29-M0 | 62.3 | 37.7 | 90.3 | 9.7 |
| 230 | siRNA30-M0 | 32.4 | 67.6 | 74.2 | 25.8 |
| 236 | siRNA31-M0 | 28.5 | 71.5 | 78.7 | 21.3 |
| 238 | siRNA32-M0 | 64.3 | 35.7 | 84.8 | 15.2 |
| 242 | siRNA33-M0 | 45.9 | 54.1 | 76.3 | 23.7 |
| 243 | siRNA34-M0 | 41.5 | 58.5 | 86.1 | 13.9 |
| 244 | siRNA35-M0 | 80.3 | 19.7 | 70.6 | 29.4 |
| 245 | siRNA36-M0 | 38.8 | 61.2 | 53.7 | 46.3 |
| 246 | siRNA37-M0 | 81.0 | 19.0 | 75.5 | 24.5 |
| 251 | siRNA38-M0 | 29.6 | 70.4 | 50.1 | 49.9 |

TABLE 6-continued

In vitro Screening of siRNAs

| Start_19mer | siRNA#* | % mRNA remaining_1 nM | KD_1 nM | % mRNA remaining_0.1 nM | KD_0.1 nM |
|---|---|---|---|---|---|
| 253 | siRNA39-M0 | 68.2 | 31.8 | 199.0 | −99.0 |
| 254 | siRNA40-M0 | 18.7 | 81.3 | 70.7 | 29.3 |
| 262 | siRNA41-M0 | 37.7 | 62.3 | 62.7 | 37.3 |
| 264 | siRNA42-M0 | 48.7 | 51.3 | 87.2 | 12.8 |
| 266 | siRNA43-M0 | 66.8 | 33.2 | 72.8 | 27.2 |
| 267 | siRNA44-M0 | 75.4 | 24.6 | 90.9 | 9.1 |
| 268 | siRNA45-M0 | 17.6 | 82.4 | 56.3 | 43.7 |
| 291 | siRNA46-M0 | 53.0 | 47.0 | 74.6 | 25.4 |
| 292 | siRNA47-M0 | 17.4 | 82.6 | 36.7 | 63.3 |
| 294 | siRNA48-M0 | 73.0 | 27.0 | 90.1 | 9.9 |
| 300 | siRNA49-M0 | 37.2 | 62.8 | 58.8 | 41.2 |
| 302 | siRNA50-M0 | 32.2 | 67.8 | 69.4 | 30.6 |
| 303 | siRNA51-M0 | 23.6 | 76.4 | 50.3 | 49.7 |
| 304 | siRNA52-M0 | 22.7 | 77.3 | 67.5 | 32.5 |
| 305 | siRNA53-M0 | 58.9 | 41.1 | 83.0 | 17.0 |
| 309 | siRNA54-M0 | 33.2 | 66.8 | 76.9 | 23.1 |
| 310 | siRNA55-M0 | 79.3 | 20.7 | 74.7 | 25.3 |
| 311 | siRNA56-M0 | 87.0 | 13.0 | 80.3 | 19.7 |
| 312 | siRNA57-M0 | 65.3 | 34.7 | 94.3 | 5.7 |
| 313 | siRNA58-M0 | 63.3 | 36.7 | 88.1 | 11.9 |
| 315 | siRNA59-M0 | 78.7 | 21.3 | 82.2 | 17.8 |
| 319 | siRNA60-M0 | 68.6 | 31.4 | 76.6 | 23.4 |
| 360 | siRNA61-M0 | 50.5 | 49.5 | 75.9 | 24.1 |
| 363 | siRNA62-M0 | 52.4 | 47.6 | 86.7 | 13.3 |
| 372 | siRNA63-M0 | 26.8 | 73.2 | 79.6 | 20.4 |
| 375 | siRNA64-M0 | 45.3 | 54.7 | 109.1 | −9.1 |
| 377 | siRNA65-M0 | 62.0 | 38.0 | 90.3 | 9.7 |
| 390 | siRNA66-M0 | 59.6 | 40.4 | 62.0 | 38.0 |
| 392 | siRNA67-M0 | 78.8 | 21.2 | 99.8 | 0.2 |
| 394 | siRNA68-M0 | 43.1 | 56.9 | 90.5 | 9.5 |
| 474 | siRNA69-M0 | 53.5 | 46.5 | 89.6 | 10.4 |
| 475 | siRNA70-M0 | 70.0 | 30.0 | 80.9 | 19.1 |
| 476 | siRNA71-M0 | 64.7 | 35.3 | 80.0 | 20.0 |
| 477 | siRNA72-M0 | 23.2 | 76.8 | 48.9 | 51.1 |
| 478 | siRNA73-M0 | 25.9 | 74.1 | 46.0 | 54.0 |
| 482 | siRNA74-M0 | 61.0 | 39.0 | 82.6 | 17.4 |
| 484 | siRNA75-M0 | 66.9 | 33.1 | 76.9 | 23.1 |
| 486 | siRNA76-M0 | 61.2 | 38.8 | 87.4 | 12.6 |
| 488 | siRNA77-M0 | 62.0 | 38.0 | 86.3 | 13.7 |
| 501 | siRNA78-M0 | 51.1 | 48.9 | 73.7 | 26.3 |
| 503 | siRNA79-M0 | 28.5 | 71.5 | 76.7 | 23.3 |
| 505 | siRNA80-M0 | 37.2 | 62.8 | 74.7 | 25.3 |
| 506 | siRNA81-M0 | 15.8 | 84.2 | 52.8 | 47.2 |
| 507 | siRNA82-M0 | 83.3 | 16.7 | 83.8 | 16.2 |
| 509 | siRNA83-M0 | 75.5 | 24.5 | 103.0 | −3.0 |
| 510 | siRNA84-M0 | 70.6 | 29.4 | 108.8 | −8.8 |
| 511 | siRNA85-M0 | 166.5 | −66.5 | 86.8 | 13.2 |
| 512 | siRNA86-M0 | 60.3 | 39.7 | 96.0 | 4.0 |
| 513 | siRNA87-M0 | 71.0 | 29.0 | 82.7 | 17.3 |
| 514 | siRNA88-M0 | 65.6 | 34.4 | 58.5 | 41.5 |
| 539 | siRNA89-M0 | 85.3 | 14.7 | 77.3 | 22.7 |
| 552 | siRNA90-M0 | 46.8 | 53.2 | 68.3 | 31.7 |
| 562 | siRNA91-M0 | 82.4 | 17.6 | 87.1 | 12.9 |
| 563 | siRNA92-M0 | 60.7 | 39.3 | 93.3 | 6.7 |
| 564 | siRNA93-M0 | 36.6 | 63.4 | 71.0 | 29.0 |
| 585 | siRNA94-M0 | 68.5 | 31.5 | 99.6 | 0.4 |
| 587 | siRNA95-M0 | 63.2 | 36.8 | 93.8 | 6.2 |
| 588 | siRNA96-M0 | 59.7 | 40.3 | 96.2 | 3.8 |
| 589 | siRNA97-M0 | 29.5 | 70.5 | 73.1 | 26.9 |
| 593 | siRNA98-M0 | 58.5 | 41.5 | 99.3 | 0.7 |
| 594 | siRNA99-M0 | 70.2 | 29.8 | 70.8 | 29.2 |
| 595 | siRNA100-M0 | 15.0 | 85.0 | 46.2 | 53.8 |
| 602 | siRNA101-M0 | 17.7 | 82.3 | 52.6 | 47.4 |
| 605 | siRNA102-M0 | 61.8 | 38.2 | 88.4 | 11.6 |
| 606 | siRNA103-M0 | 19.1 | 80.9 | 62.5 | 37.5 |
| 607 | siRNA104-M0 | 70.8 | 29.2 | 65.4 | 34.6 |
| 608 | siRNA105-M0 | 50.4 | 49.6 | 82.4 | 17.6 |
| 609 | siRNA106-M0 | 36.2 | 63.8 | 63.7 | 36.3 |
| 610 | siRNA107-M0 | 61.5 | 38.5 | 69.4 | 30.6 |
| 612 | siRNA108-M0 | 30.1 | 69.9 | 68.4 | 31.6 |
| 613 | siRNA109-M0 | 22.6 | 77.4 | 65.7 | 34.3 |
| 653 | siRNA110-M0 | 20.4 | 79.6 | 70.4 | 29.6 |
| 663 | siRNA111-M0 | 19.1 | 80.9 | 65.1 | 34.9 |
| 665 | siRNA112-M0 | 32.2 | 67.8 | 55.1 | 44.9 |
| 666 | siRNA113-M0 | 34.6 | 65.4 | 58.6 | 41.4 |

TABLE 6-continued

In vitro Screening of siRNAs

| Start_19mer | siRNA#* | % mRNA remaining_1 nM | KD_1 nM | % mRNA remaining_0.1 nM | KD_0.1 nM |
|---|---|---|---|---|---|
| 667 | siRNA114-M0 | 34.2 | 65.8 | 83.3 | 16.7 |
| 669 | siRNA115-M0 | 75.7 | 24.3 | 96.6 | 3.4 |
| 670 | siRNA116-M0 | 26.2 | 73.8 | 65.4 | 34.6 |
| 671 | siRNA117-M0 | 60.5 | 39.5 | 71.7 | 28.3 |
| 673 | siRNA118-M0 | 9.7 | 90.3 | 38.7 | 61.3 |
| 679 | siRNA119-M0 | 55.5 | 44.5 | 84.2 | 15.8 |
| 712 | siRNA120-M0 | 65.2 | 34.8 | 72.5 | 27.5 |
| 771 | siRNA121-M0 | 82.5 | 17.5 | 77.6 | 22.4 |
| 781 | siRNA122-M0 | 20.7 | 79.3 | 52.3 | 47.7 |
| 788 | siRNA123-M0 | 77.9 | 22.1 | 94.1 | 5.9 |
| 841 | siRNA124-M0 | 13.0 | 87.0 | 51.1 | 48.9 |
| 844 | siRNA125-M0 | 7.6 | 92.4 | 28.0 | 72.0 |
| 846 | siRNA126-M0 | 61.9 | 38.1 | 84.7 | 15.3 |
| 850 | siRNA127-M0 | 88.0 | 12.0 | 85.0 | 15.0 |
| 851 | siRNA128-M0 | 72.2 | 27.8 | 85.3 | 14.7 |
| 852 | siRNA129-M0 | 48.8 | 51.2 | 73.3 | 26.7 |
| 861 | siRNA130-M0 | 84.9 | 15.1 | 72.1 | 27.9 |
| 862 | siRNA131-M0 | 50.4 | 49.6 | 79.9 | 20.1 |
| 901 | siRNA132-M0 | 98.1 | 1.9 | 79.6 | 20.4 |
| 903 | siRNA133-M0 | 99.1 | 0.9 | 93.7 | 6.3 |
| 904 | siRNA134-M0 | 79.7 | 20.3 | 75.1 | 24.9 |
| 905 | siRNA135-M0 | 84.8 | 15.2 | 100.5 | −0.5 |
| 906 | siRNA136-M0 | 70.7 | 29.3 | 86.1 | 13.9 |
| 912 | siRNA137-M0 | 35.4 | 64.6 | 90.7 | 9.3 |
| 915 | siRNA138-M0 | 43.9 | 56.1 | 86.4 | 13.6 |
| 916 | siRNA139-M0 | 63.9 | 36.1 | 91.5 | 8.5 |
| 917 | siRNA140-M0 | 41.6 | 58.4 | 80.4 | 19.6 |
| 920 | siRNA141-M0 | 20.2 | 79.8 | 74.2 | 25.8 |
| 921 | siRNA142-M0 | 104.4 | −4.4 | 74.8 | 25.2 |
| 950 | siRNA143-M0 | 67.8 | 32.2 | 55.3 | 44.7 |
| 954 | siRNA144-M0 | 28.9 | 71.1 | 79.0 | 21.0 |
| 955 | siRNA145-M0 | 61.3 | 38.7 | 71.7 | 28.3 |
| 956 | siRNA146-M0 | 70.6 | 29.4 | 74.0 | 26.0 |
| 957 | siRNA147-M0 | 93.4 | 6.6 | 82.9 | 17.1 |
| 980 | siRNA148-M0 | 63.1 | 36.9 | 96.1 | 3.9 |
| 982 | siRNA149-M0 | 40.3 | 59.7 | 72.4 | 27.6 |
| 983 | siRNA150-M0 | 72.8 | 27.2 | 80.2 | 19.8 |
| 988 | siRNA151-M0 | 46.7 | 53.3 | 84.6 | 15.4 |
| 989 | siRNA152-M0 | 18.4 | 81.6 | 60.0 | 40.0 |
| 992 | siRNA153-M0 | 43.2 | 56.8 | 63.3 | 36.7 |
| 993 | siRNA154-M0 | 47.7 | 52.3 | 81.5 | 18.5 |
| 994 | siRNA155-M0 | 53.3 | 46.7 | 64.3 | 35.7 |
| 995 | siRNA156-M0 | 24.7 | 75.3 | 77.8 | 22.2 |
| 996 | siRNA157-M0 | 17.3 | 82.7 | 73.5 | 26.5 |
| 1005 | siRNA158-M0 | 10.9 | 89.1 | 49.9 | 50.1 |
| 1006 | siRNA159-M0 | 49.9 | 50.1 | 80.6 | 19.4 |
| 1007 | siRNA160-M0 | 28.5 | 71.5 | 71.7 | 28.3 |
| 1011 | siRNA161-M0 | 20.7 | 79.3 | 33.4 | 66.6 |
| 1012 | siRNA162-M0 | 42.4 | 57.6 | 84.6 | 15.4 |
| 1013 | siRNA163-M0 | 81.6 | 18.4 | 83.4 | 16.6 |
| 1018 | siRNA164-M0 | 84.5 | 15.5 | 89.5 | 10.5 |
| 1019 | siRNA165-M0 | 24.9 | 75.1 | 55.2 | 44.8 |
| 1020 | siRNA166-M0 | 25.7 | 74.3 | 76.2 | 23.8 |
| 1021 | siRNA167-M0 | 67.7 | 32.3 | 83.9 | 16.1 |
| 1026 | siRNA168-M0 | 55.9 | 44.1 | 76.2 | 23.8 |
| 1027 | siRNA169-M0 | 75.7 | 24.3 | 71.9 | 28.1 |
| 1029 | siRNA170-M0 | 85.4 | 14.6 | 100.6 | −0.6 |
| 1036 | siRNA171-M0 | 39.8 | 60.2 | 68.1 | 31.9 |
| 1039 | siRNA172-M0 | 9.0 | 91.0 | 31.4 | 68.6 |
| 1042 | siRNA173-M0 | 49.2 | 50.8 | 86.8 | 13.2 |
| 1084 | siRNA174-M0 | 10.5 | 89.5 | 33.0 | 67.0 |
| 1087 | siRNA175-M0 | 39.2 | 60.8 | 73.1 | 26.9 |
| 1134 | siRNA176-M0 | 81.8 | 18.2 | 87.0 | 13.0 |
| 1151 | siRNA177-M0 | 67.9 | 32.1 | 88.7 | 11.3 |
| 1152 | siRNA178-M0 | 41.0 | 59.0 | 90.1 | 9.9 |
| 1155 | siRNA179-M0 | 46.8 | 53.2 | 71.1 | 28.9 |
| 1158 | siRNA180-M0 | 62.8 | 37.2 | 81.5 | 18.5 |
| 1160 | siRNA181-M0 | 87.0 | 13.0 | 90.4 | 9.6 |
| 1162 | siRNA182-M0 | 28.9 | 71.1 | 94.0 | 6.0 |
| 1165 | siRNA183-M0 | 73.3 | 26.7 | 71.3 | 28.7 |
| 1168 | siRNA184-M0 | 29.1 | 70.9 | 76.2 | 23.8 |
| 1169 | siRNA185-M0 | 19.9 | 80.1 | 76.9 | 23.1 |
| 1174 | siRNA186-M0 | 42.3 | 57.7 | 69.9 | 30.1 |
| 1177 | siRNA187-M0 | 32.2 | 67.8 | 83.9 | 16.1 |
| 1178 | siRNA188-M0 | 49.5 | 50.5 | 101.8 | −1.8 |

TABLE 6-continued

In vitro Screening of siRNAs

| Start_19mer | siRNA#* | % mRNA remaining_1 nM | KD_1 nM | % mRNA remaining_0.1 nM | KD_0.1 nM |
|---|---|---|---|---|---|
| 1189 | siRNA189-M0 | 76.9 | 23.1 | 76.3 | 23.7 |
| 1191 | siRNA190-M0 | 19.6 | 80.4 | 33.9 | 66.1 |
| 1194 | siRNA191-M0 | 63.8 | 36.2 | 94.1 | 5.9 |
| 1196 | siRNA192-M0 | 85.1 | 14.9 | 83.6 | 16.4 |
| 1200 | siRNA193-M0 | 48.4 | 51.6 | 78.3 | 21.7 |
| 1201 | siRNA194-M0 | 25.3 | 74.7 | 60.4 | 39.6 |
| 1203 | siRNA195-M0 | 63.4 | 36.6 | 92.5 | 7.5 |
| 1204 | siRNA196-M0 | 192.8 | −92.8 | 147.7 | −47.7 |
| 1205 | siRNA197-M0 | 17.4 | 82.6 | 58.1 | 41.9 |
| 1207 | siRNA198-M0 | 40.2 | 59.8 | 82.9 | 17.1 |
| 1209 | siRNA199-M0 | 14.3 | 85.7 | 50.9 | 49.1 |
| 1212 | siRNA200-M0 | 19.7 | 80.3 | 67.2 | 32.8 |
| 1214 | siRNA201-M0 | 26.4 | 73.6 | 81.1 | 18.9 |
| 1215 | siRNA202-M0 | 23.8 | 76.2 | 60.0 | 40.0 |
| 1217 | siRNA203-M0 | 14.6 | 85.4 | 44.6 | 55.4 |
| 1226 | siRNA204-M0 | 69.0 | 31.0 | 92.1 | 7.9 |
| 1227 | siRNA205-M0 | 10.9 | 89.1 | 32.1 | 67.9 |
| 1228 | siRNA206-M0 | 9.2 | 90.8 | 44.2 | 55.8 |
| 1229 | siRNA207-M0 | 23.4 | 76.6 | 78.7 | 21.3 |
| 1230 | siRNA208-M0 | 16.8 | 83.2 | 70.6 | 29.4 |
| 1231 | siRNA209-M0 | 18.5 | 81.5 | 72.0 | 28.0 |
| 1233 | siRNA210-M0 | 15.8 | 84.2 | 71.0 | 29.0 |
| 1236 | siRNA211-M0 | 73.4 | 26.6 | 80.9 | 19.1 |
| 1237 | siRNA212-M0 | 24.5 | 75.5 | 44.1 | 55.9 |
| 1238 | siRNA213-M0 | 36.5 | 63.5 | 98.3 | 1.7 |
| 1239 | siRNA214-M0 | 41.1 | 58.9 | 79.0 | 21.0 |
| 1240 | siRNA215-M0 | 16.5 | 83.5 | 65.4 | 34.6 |
| 1241 | siRNA216-M0 | 18.8 | 81.2 | 55.0 | 45.0 |
| 1242 | siRNA217-M0 | 13.0 | 87.0 | 53.6 | 46.4 |
| 1248 | siRNA218-M0 | 42.3 | 57.7 | 57.4 | 42.6 |
| 1249 | siRNA219-M0 | 37.1 | 62.9 | 67.3 | 32.7 |
| 1261 | siRNA220-M0 | 30.8 | 69.2 | 77.4 | 22.6 |
| 1283 | siRNA221-M0 | 52.0 | 48.0 | 88.6 | 11.4 |
| 1285 | siRNA222-M0 | 91.2 | 8.8 | 88.3 | 11.7 |
| 1286 | siRNA223-M0 | 54.9 | 45.1 | 88.2 | 11.8 |
| 1288 | siRNA224-M0 | 49.7 | 50.3 | 79.4 | 20.6 |
| 1290 | siRNA225-M0 | 26.9 | 73.1 | 77.2 | 22.8 |
| 1291 | siRNA226-M0 | 42.0 | 58.0 | 47.1 | 52.9 |
| 1292 | siRNA227-M0 | 38.2 | 61.8 | 72.9 | 27.1 |
| 1293 | siRNA228-M0 | 31.7 | 68.3 | 71.0 | 29.0 |
| 1296 | siRNA229-M0 | 33.3 | 66.7 | 72.3 | 27.7 |
| 1297 | siRNA230-M0 | 34.0 | 66.0 | 78.5 | 21.5 |
| 1298 | siRNA231-M0 | 18.8 | 81.2 | 39.3 | 60.7 |
| 1299 | siRNA232-M0 | 40.9 | 59.1 | 76.8 | 23.2 |
| 1300 | siRNA233-M0 | 131.7 | −31.7 | 83.1 | 16.9 |
| 1301 | siRNA234-M0 | 31.8 | 68.2 | 74.9 | 25.1 |
| 1302 | siRNA235-M0 | 61.4 | 38.6 | 80.7 | 19.3 |
| 1303 | siRNA236-M0 | 31.1 | 68.9 | 69.7 | 30.3 |
| 1306 | siRNA237-M0 | 24.4 | 75.6 | 67.8 | 32.2 |
| 1307 | siRNA238-M0 | 39.1 | 60.9 | 84.7 | 15.3 |
| 1311 | siRNA239-M0 | 42.0 | 58.0 | 65.8 | 34.2 |
| 1313 | siRNA240-M0 | 55.4 | 44.6 | 87.5 | 12.5 |
| 1314 | siRNA241-M0 | 24.0 | 76.0 | 80.3 | 19.7 |
| 1353 | siRNA242-M0 | 19.9 | 80.1 | 68.9 | 31.1 |
| 1354 | siRNA243-M0 | 54.1 | 45.9 | 74.2 | 25.8 |
| 1358 | siRNA244-M0 | 77.0 | 23.0 | 84.7 | 15.3 |
| 1360 | siRNA245-M0 | 23.7 | 76.3 | 61.7 | 38.3 |
| 1361 | siRNA246-M0 | 48.1 | 51.9 | 82.5 | 17.5 |
| 1363 | siRNA247-M0 | 26.4 | 73.6 | 83.7 | 16.3 |
| 1364 | siRNA248-M0 | 24.1 | 75.9 | 67.2 | 32.8 |
| 1382 | siRNA249-M0 | 56.8 | 43.2 | 96.7 | 3.3 |
| 1386 | siRNA250-M0 | 16.1 | 83.9 | 44.4 | 55.6 |
| 1388 | siRNA251-M0 | 21.5 | 78.5 | 64.7 | 35.3 |
| 1389 | siRNA252-M0 | 28.5 | 71.5 | 83.3 | 16.7 |
| 1413 | siRNA253-M0 | 35.5 | 64.5 | 77.6 | 22.4 |
| 1415 | siRNA254-M0 | 34.9 | 65.1 | 76.4 | 23.6 |
| 1416 | siRNA255-M0 | 61.0 | 39.0 | 75.9 | 24.1 |
| 1417 | siRNA256-M0 | 14.6 | 85.4 | 29.7 | 70.3 |
| 1424 | siRNA257-M0 | 25.8 | 74.2 | 76.1 | 23.9 |
| 1425 | siRNA258-M0 | 61.4 | 38.6 | 95.1 | 4.9 |
| 1431 | siRNA259-M0 | 18.1 | 81.9 | 61.2 | 38.8 |
| 1433 | siRNA260-M0 | 13.9 | 86.1 | 52.7 | 47.3 |
| 1506 | siRNA261-M0 | 75.2 | 24.8 | 97.4 | 2.6 |
| 1507 | siRNA262-M0 | 68.1 | 31.9 | 87.1 | 12.9 |
| 1510 | siRNA263-M0 | 94.6 | 5.4 | 88.2 | 11.8 |

TABLE 6-continued

In vitro Screening of siRNAs

| Start_19mer | siRNA#* | % mRNA remaining_1 nM | KD_1 nM | % mRNA remaining_0.1 nM | KD_0.1 nM |
|---|---|---|---|---|---|
| 1511 | siRNA264-M0 | 220.8 | −120.8 | 89.1 | 10.9 |
| 1513 | siRNA265-M0 | 69.5 | 30.5 | 80.5 | 19.5 |
| 1518 | siRNA266-M0 | 73.7 | 26.3 | 87.5 | 12.5 |
| 1555 | siRNA267-M0 | 77.4 | 22.6 | 83.5 | 16.5 |
| 1556 | siRNA268-M0 | 61.1 | 38.9 | 72.1 | 27.9 |
| 1557 | siRNA269-M0 | 66.4 | 33.6 | 66.5 | 33.5 |
| 1558 | siRNA270-M0 | 42.5 | 57.5 | 79.8 | 20.2 |
| 1559 | siRNA271-M0 | 75.3 | 24.7 | 81.0 | 19.0 |
| 1561 | siRNA272-M0 | 20.7 | 79.3 | 39.8 | 60.2 |
| 1593 | siRNA273-M0 | 99.5 | 0.5 | 95.6 | 4.4 |
| 1594 | siRNA274-M0 | 81.6 | 18.4 | 77.0 | 23.0 |
| 1597 | siRNA275-M0 | 70.3 | 29.7 | 99.0 | 1.0 |
| 1599 | siRNA276-M0 | 89.3 | 10.7 | 74.0 | 26.0 |
| 1601 | siRNA277-M0 | 86.2 | 13.8 | 69.5 | 30.5 |
| 1605 | siRNA278-M0 | 83.1 | 16.9 | 84.7 | 15.3 |
| 1606 | siRNA279-M0 | 87.5 | 12.5 | 74.1 | 25.9 |
| 1609 | siRNA280-M0 | 92.3 | 7.7 | 70.9 | 29.1 |
| 1610 | siRNA281-M0 | 77.7 | 22.3 | 81.0 | 19.0 |
| 1614 | siRNA282-M0 | 76.2 | 23.8 | 76.5 | 23.5 |
| 1638 | siRNA283-M0 | 91.0 | 9.0 | 87.1 | 12.9 |
| 1660 | siRNA284-M0 | 83.7 | 16.3 | 87.9 | 12.1 |
| 1661 | siRNA285-M0 | 88.0 | 12.0 | 74.9 | 25.1 |
| 1662 | siRNA286-M0 | 95.5 | 4.5 | 84.6 | 15.4 |
| 1663 | siRNA287-M0 | 100.1 | −0.1 | 88.9 | 11.1 |
| 1669 | siRNA288-M0 | 84.0 | 16.0 | 85.6 | 14.4 |
| 1671 | siRNA289-M0 | 81.0 | 19.0 | 76.3 | 23.7 |
| 1673 | siRNA290-M0 | 66.1 | 33.9 | 84.0 | 16.0 |
| 1676 | siRNA291-M0 | 70.8 | 29.2 | 60.1 | 39.9 |
| 1683 | siRNA292-M0 | 93.8 | 6.2 | 87.5 | 12.5 |
| 1686 | siRNA293-M0 | 89.6 | 10.4 | 79.9 | 20.1 |
| 1689 | siRNA294-M0 | 72.5 | 27.5 | 86.6 | 13.4 |
| 1690 | siRNA295-M0 | 78.9 | 21.1 | 84.9 | 15.1 |
| 1692 | siRNA296-M0 | 82.3 | 17.7 | 83.8 | 16.2 |
| 1712 | siRNA297-M0 | 85.0 | 15.0 | 67.3 | 32.7 |
| 1713 | siRNA298-M0 | 81.0 | 19.0 | 82.0 | 18.0 |
| 1769 | siRNA299-M0 | 89.8 | 10.2 | 72.7 | 27.3 |
| 1770 | siRNA300-M0 | 84.2 | 15.8 | 91.3 | 8.7 |
| 1824 | siRNA301-M0 | 95.1 | 4.9 | 88.3 | 11.7 |
| 1825 | siRNA302-M0 | 82.2 | 17.8 | 82.2 | 17.8 |
| 1826 | siRNA303-M0 | 94.2 | 5.8 | 97.6 | 2.4 |
| 1827 | siRNA304-M0 | 90.7 | 9.3 | 70.4 | 29.6 |
| 1828 | siRNA305-M0 | 73.2 | 26.8 | 97.4 | 2.6 |
| 1829 | siRNA306-M0 | 84.5 | 15.5 | 82.5 | 17.5 |
| 1830 | siRNA307-M0 | 87.6 | 12.4 | 72.7 | 27.3 |
| 1895 | siRNA308-M0 | 73.2 | 26.8 | 93.4 | 6.6 |
| 2052 | siRNA309-M0 | 89.0 | 11.0 | 71.4 | 28.6 |
| 2053 | siRNA310-M0 | 82.2 | 17.8 | 82.6 | 17.4 |
| 2075 | siRNA311-M0 | 87.6 | 12.4 | 94.8 | 5.2 |
| 2127 | siRNA312-M0 | 70.3 | 29.7 | 83.7 | 16.3 |
| 2128 | siRNA313-M0 | 88.9 | 11.1 | 75.2 | 24.8 |
| 2132 | siRNA314-M0 | 81.8 | 18.2 | 96.2 | 3.8 |
| 2133 | siRNA315-M0 | 76.5 | 23.5 | 83.6 | 16.4 |
| 2134 | siRNA316-M0 | 77.5 | 22.5 | 102.2 | −2.2 |
| 2135 | siRNA317-M0 | 215.9 | −115.9 | 84.5 | 15.5 |
| 2136 | siRNA318-M0 | 74.7 | 25.3 | 91.1 | 8.9 |
| 2137 | siRNA319-M0 | 77.0 | 23.0 | 77.9 | 22.1 |
| 2139 | siRNA320-M0 | 79.1 | 20.9 | 89.0 | 11.0 |
| 2140 | siRNA321-M0 | 91.0 | 9.0 | 87.2 | 12.8 |
| 2144 | siRNA322-M0 | 92.0 | 8.0 | 109.0 | −9.0 |
| 2189 | siRNA323-M0 | 91.3 | 8.7 | 75.1 | 24.9 |
| 2190 | siRNA324-M0 | 66.9 | 33.1 | 95.5 | 4.5 |
| 2191 | siRNA325-M0 | 90.3 | 9.7 | 76.3 | 23.7 |
| 2192 | siRNA326-M0 | 80.4 | 19.6 | 89.2 | 10.8 |
| 2193 | siRNA327-M0 | 68.6 | 31.4 | 90.3 | 9.7 |
| 2194 | siRNA328-M0 | 87.0 | 13.0 | 67.6 | 32.4 |
| 2195 | siRNA329-M0 | 70.1 | 29.9 | 98.0 | 2.0 |
| 2199 | siRNA330-M0 | 80.0 | 20.0 | 74.5 | 25.5 |
| 2209 | siRNA331-M0 | 67.3 | 32.7 | 94.6 | 5.4 |
| 2210 | siRNA332-M0 | 91.9 | 8.1 | 72.9 | 27.1 |
| 2211 | siRNA333-M0 | 78.6 | 21.4 | 75.7 | 24.3 |
| 2215 | siRNA334-M0 | 86.8 | 13.2 | 73.1 | 26.9 |
| 2216 | siRNA335-M0 | 70.6 | 29.4 | 98.7 | 1.3 |
| 2217 | siRNA336-M0 | 89.4 | 10.6 | 77.7 | 22.3 |
| 2218 | siRNA337-M0 | 78.0 | 22.0 | 103.6 | −3.6 |
| 2220 | siRNA338-M0 | 77.2 | 22.8 | 107.3 | −7.3 |

TABLE 6-continued

In vitro Screening of siRNAs

| Start_19mer | siRNA#* | % mRNA remaining_1 nM | KD_1 nM | % mRNA remaining_0.1 nM | KD_0.1 nM |
|---|---|---|---|---|---|
| 2221 | siRNA339-M0 | 76.6 | 23.4 | 87.1 | 12.9 |
| 2223 | siRNA340-M0 | 78.4 | 21.6 | 84.5 | 15.5 |
| 2224 | siRNA341-M0 | 88.3 | 11.7 | 76.5 | 23.5 |
| 2225 | siRNA342-M0 | 73.1 | 26.9 | 64.5 | 35.5 |
| 2313 | siRNA343-M0 | 100.1 | −0.1 | 78.6 | 21.4 |
| 2316 | siRNA344-M0 | 78.0 | 22.0 | 80.5 | 19.5 |
| 2317 | siRNA345-M0 | 91.2 | 8.8 | 94.7 | 5.3 |
| 2319 | siRNA346-M0 | 87.0 | 13.0 | 76.9 | 23.1 |
| 2320 | siRNA347-M0 | 67.4 | 32.6 | 90.1 | 9.9 |
| 2321 | siRNA348-M0 | 82.4 | 17.6 | 93.8 | 6.2 |
| 2353 | siRNA349-M0 | 87.9 | 12.1 | 71.9 | 28.1 |
| 2355 | siRNA350-M0 | 92.7 | 7.3 | 73.7 | 26.3 |
| 2356 | siRNA351-M0 | 89.1 | 10.9 | 70.4 | 29.6 |
| 2362 | siRNA352-M0 | 78.1 | 21.9 | 78.9 | 21.1 |
| 2364 | siRNA353-M0 | 71.1 | 28.9 | 108.2 | −8.2 |
| 2365 | siRNA354-M0 | 78.5 | 21.5 | 86.1 | 13.9 |
| 2366 | siRNA355-M0 | 80.7 | 19.3 | 96.5 | 3.5 |
| 2370 | siRNA356-M0 | 80.5 | 19.5 | 85.4 | 14.6 |
| 2503 | siRNA357-M0 | 71.6 | 28.4 | 72.1 | 27.9 |
| 2562 | siRNA358-M0 | 87.5 | 12.5 | 79.4 | 20.6 |
| 2563 | siRNA359-M0 | 96.3 | 3.7 | 78.3 | 21.7 |
| 2620 | siRNA360-M0 | 87.4 | 12.6 | 73.9 | 26.1 |
| 2621 | siRNA361-M0 | 66.9 | 33.1 | 90.9 | 9.1 |
| 2622 | siRNA362-M0 | 83.8 | 16.2 | 79.2 | 20.8 |
| 2623 | siRNA363-M0 | 84.1 | 15.9 | 76.1 | 23.9 |
| 2624 | siRNA364-M0 | 83.8 | 16.2 | 88.9 | 11.1 |
| 2625 | siRNA365-M0 | 78.8 | 21.2 | 81.5 | 18.5 |
| 2629 | siRNA366-M0 | 71.5 | 28.5 | 87.7 | 12.3 |
| 2630 | siRNA367-M0 | 96.6 | 3.4 | 87.7 | 12.3 |
| 2632 | siRNA368-M0 | 96.0 | 4.0 | 85.8 | 14.2 |
| 2633 | siRNA369-M0 | 80.4 | 19.6 | 92.6 | 7.4 |
| 2635 | siRNA370-M0 | 185.9 | −85.9 | 80.3 | 19.7 |
| 2639 | siRNA371-M0 | 97.2 | 2.8 | 75.4 | 24.6 |
| 2679 | siRNA372-M0 | 69.8 | 30.2 | 97.7 | 2.3 |
| 2682 | siRNA373-M0 | 92.1 | 7.9 | 84.9 | 15.1 |
| 2683 | siRNA374-M0 | 78.0 | 22.0 | 86.0 | 14.0 |
| 2687 | siRNA375-M0 | 79.6 | 20.4 | 79.1 | 20.9 |
| 2690 | siRNA376-M0 | 79.8 | 20.2 | 81.5 | 18.5 |
| 2691 | siRNA377-M0 | 99.8 | 0.2 | 79.3 | 20.7 |
| 2692 | siRNA378-M0 | 78.3 | 21.7 | 79.0 | 21.0 |
| 2833 | siRNA379-M0 | 78.2 | 21.8 | 82.1 | 17.9 |
| 2834 | siRNA380-M0 | 193.4 | −93.4 | 88.9 | 11.1 |
| 2835 | siRNA381-M0 | 94.4 | 5.6 | 82.8 | 17.2 |
| 2838 | siRNA382-M0 | 81.5 | 18.5 | 158.5 | −58.5 |
| 2839 | siRNA383-M0 | 76.9 | 23.1 | 80.2 | 19.8 |
| 2858 | siRNA384-M0 | 85.5 | 14.5 | 75.3 | 24.7 |

'*siRNA# in Table 6 correspond to the siRNA# in Table 5B

Example 4: In Vivo Screening of siRNA Agents in Mouse

Initial Screening

Based in the in vitro screening results, 30 target sequences were selected for further study. siRNAs were then prepared as fully chemically modified siRNA conjugated to a targeting moiety comprising a structure of Formula ($Z^6$). A combination of 2'-O-methyl-RNA phosphoramidites and 2'-Deoxy-2'-fluoro-RNA phosphoramidites were used to obtain siRNA for in vivo study (FIG. 1, Table 7B). Monomer phosphoramidites were used to incorporate the targeting moiety at the 3'-end of the sense strand. Table 7A provides the nucleobase sequences of the siRNAs. It is to be understood that any chemical modification pattern may be applied to the nucleobase sequences of the siRNAs in Table 7A. For the initial screening, modification pattern MOD 3 (see FIG. 1) was used. Table 7B below lists the exemplary siRNAs used for the initial in vivo screening in mouse.

Chemically Modified Duplex siRNA Preparation

Oligoribonucleotides were synthesized according to the phosphoramidite technology on solid phase employing a Mermade 12 synthesizer (LGC Bioautomation). Syntheses were performed on a solid support made of controlled pore glass (CPG). Specifically, oligonucleotides were assembled on a 500 Å universal solid support with a loading of 89.3 μmol/g, purchased from Chemgenes. All 2'-modified RNA phosphoramidites as well as ancillary reagents were purchased from commercially available resources. Specifically, the following 2'-O-Methyl phosphoramidites were used: (5'-O-dimethoxytrityl-N6-(benzoyl)-2'-O-methyl-adenosine-3'-O-(2-cyanoethyl-N,N-diisopropylamino) phosphoramidite, 5'-O-dimethoxytrityl-N4-(acetyl)-2'-O-methyl-cytidine-3'-O-(2-cyanoethyl-N,N-diisopropylamino) phosphoramidite, (5'-O-dimethoxytrityl-N2-(isobutyryl)-2'-O-methyl-guanosine-3'-O-(2-cyanoethyl-N,N-diisopropylamino) phosphoramidite, and 5'-O-dimethoxytrityl-2'-O-methyl-uridine-3'-O-(2-cyanoethyl-N,N-diisopropylamino) phosphoramidite. The 2'-Deoxy-2'-fluoro-phosphoramidites carried the same protecting groups as the 2'-O-methyl RNA amidites. For introduction of the targeting moiety, 1-O-GalNAc-5-O-dimethoxytrityl-2-O-methyl-ribose-3-O-(2-cyanoethyl-N,N-diisopropylamino) phosphoramidite was used. All phosphoramidites were dissolved in anhydrous acetonitrile (100 mM) besides 5'-O-dimethoxytrityl-2'-O-methyl-uridine-3'-O-(2-cyanoethyl-N,N-diisopropylamino) phosphoramidite which was dissolved in a 20% dimethylformamide/acetonitrile solution (100 mM). Molecular sieves (3 Å) were added to all amidite solutions and reagent solutions 6 hours before the synthesis. 5-Ethyl thiotetrazole (ETT, 500 mM in acetonitrile) was used as an activator. Coupling times were 6 minutes. In order to introduce phosphorothioate linkages a 50 mM solution of 3-((Dimethylamino-methylidene)amino)-3H-1,2,4-dithiazole-3-thione (DDTT, obtained from Chemgenes, Wimington, MA, USA) in anhydrous acetonitrile/pyridine (1:1 v/v) was employed. Oligonucleotides were synthesized with removal of the final DMT protecting group ("DMT off").

Cleavage and Deprotection of Support Bound Oligomer

After finalization of the solid phase synthesis, oligonucleotides were cleaved from the solid support by the addition a mixture consisting of 5 wt % diethylamine in concentrated aqueous ammonia, both available from Sigma Aldrich). To achieve quantitative removal of all protecting groups, the solutions were incubated with shaking at 35° C. for 24 hours. The crude suspension was filtered through a 0.45 micron Millex PVDF filter, washed the solid support with additional water, then concentrated the filtrate in vacuo to remove the diethylamine and aqueous ammonia residues.

Purification of Oligoribonucleotides

Crude oligomers were purified by anionic exchange HPLC using SourceQ column (GE Healthcare, Freiburg, Germany) on an AKTA Purifier system (GE Healthcare, Freiburg, Germany). Buffer A was 20 mM sodium phosphate, pH 8 and contained 10% acetonitrile and buffer B contained 1M sodium bromide in buffer A. A flow rate of 10 mL/min and a gradient starting from 25% to 65% buffer B was employed. UV traces at 260 and 280 nm were recorded to monitor product elution. Appropriate fractions were pooled and analyzed via mass spec. Pooled oligonucleotides were desalted via size exclusion chromatography on an AKTA Purifier system (GE Healthcare, Freiburg, Germany) utilizing Milli-Q filtered water. Desalted oligonucleotides were then frozen over dry ice and lyophilized.

Annealing of Oligoribonucleotides to Generate siRNA

Complementary strands were dissolved in Milli-Q or DNAse/RNAse water, then mixed at an equimolar ratio. The mixtures were annealed using ThermoMixer C equipment (Eppendorf). It was shaked at 400 rpm and heated at 90° C. for 15 minutes, then slowly reduced to 15° C. An aliquot was sampled and analyzed using UPLC/MS (QTOF or Orbitrap) to confirm completion and proper of annealing process.

TABLE 7A

Nucleobase sequences of exemplary siRNAs‡

| Position | siRNA#* | Sense Strand Sequence | SEQ ID NO: | Anti-Sense Strand Sequence | SEQ ID NO: |
|---|---|---|---|---|---|
| 223 | siRNA27' | UCUUGAGUUCCUCAGAGCAAA | 419 | UUUGCUCUGAGGAACUCAAGAAG | 1161 |
| 844 | siRNA125' | GCGCAUGUUUCUCAAUGACAA | 517 | UUGUCAUUGAGAAACAUGCGCAG | 1162 |
| 1417 | siRNA256' | UAUCCACGAAAUCAAGCAAUA | 648 | UAUUGCUUGAUUUCGUGGAUAAG | 1163 |
| 1039 | siRNA172' | AAAAGUCAGCUUGGAAGGCAA | 564 | UUGCCUUCCAAGCUGACUUUUAG | 1164 |
| 1227 | siRNA205' | UAGCUCUUUACCCACAGUUAA | 597 | UUAACUGUGGGUAAAGAGCUAAG | 1165 |
| 1084 | siRNA174' | ACUGAAUGACCUGCCAGUAUA | 566 | UAUACUGGCAGGUCAUUCAGUAG | 1166 |
| 1011 | siRNA161' | UGAAAAGAACAUUAGAGAAUA | 553 | UAUUCUCUAAUGUUCUUUUCAAG | 1167 |
| 1191 | siRNA190' | AGGACGGUUCCUACAACAUCA | 582 | UGAUGUUGUAGGAACCGUCCUAG | 1168 |
| 292 | siRNA47' | UGUCCAUUUCAUCACAAAUCA | 439 | UGAUUUGUGAUGAAAUGGACAAG | 1169 |
| 673 | siRNA118' | UCUAAACAAUCUUGACAACUA | 510 | UAGUUGUCAAGAUUGUUUAGAAG | 1170 |
| 1298 | siRNA231' | AGGUAUCUUGAUGAAAACGGA | 623 | UCCGUUUUCAUCAAGAUACCUAG | 1171 |
| 1561 | siRNA272' | AUAUAAAUUCAAGCAUUUGUA | 664 | UACAAAUGCUUGAAUUUAUAUAG | 1172 |
| 1237 | siRNA212' | CCCACAGUUAAUGCACUUAGA | 604 | UCUAAGUGCAUUAACUGUGGGAG | 1173 |
| 1228 | siRNA206' | AGCUCUUUACCCACAGUUAAA | 598 | UUUAACUGUGGGUAAAGAGCUAG | 1174 |
| 1386 | siRNA250' | GAGCUACAAUAUGUCCUGGAA | 642 | UUCCAGGACAUAUUGUAGCUCAG | 1175 |
| 1217 | siRNA203' | GAUGACAUCAUAGCUCUUUAA | 595 | UUAAAGAGCUAUGAUGUCAUCAG | 1176 |
| 478 | siRNA73' | CUUGAAUUCCCUCACGGAAAA | 465 | UUUUCCGUGAGGGAAUUCAAGAG | 1177 |
| 595 | siRNA100' | CCGAGUGAUGUUUGAAGCUGA | 492 | UCAGCUUCAAACAUCACUCGGAG | 1178 |
| 1291 | siRNA226' | AUAUGAUAGGUAUCUUGAUGA | 618 | UCAUCAAGAUACCUAUCAUAUAG | 1179 |
| 115 | siRNA12' | UUGUCUAUGGCUUAUUCUUGA | 404 | UCAAGAAUAAGCCAUAGACAAAG | 1180 |
| 477 | siRNA72' | CCUUGAAUUCCCUCACGGAAA | 464 | UUUCCGUGAGGGAAUUCAAGGAG | 1181 |

TABLE 7A-continued

| Nucleobase sequences of exemplary siRNAs‡ | | | | | |
|---|---|---|---|---|---|
| Position | siRNA#* | Sense Strand Sequence | SEQ ID NO: | Anti-Sense Strand Sequence | SEQ ID NO: |
| 1005 | siRNA158' | AAGAAGUGAAAAGAACAUUAA | 550 | UUAAUGUUCUUUUCACUUCUUAG | 1182 |
| 251 | siRNA38' | AAACAUGGUCAUGUUUUUACA | 430 | UGUAAAAACAUGACCAUGUUUAG | 1183 |
| 303 | siRNA51'- | UCACAAAUCCCUUGUCAUACA | 443 | UGUAUGACAAGGGAUUUGUGAAG | 1184 |
| 1209 | siRNA199' | UCCGAAAAGAUGACAUCAUAA | 591 | UUAUGAUGUCAUCUUUUCGGAAG | 1185 |
| 841 | siRNA124' | CCUGCGCAUGUUUCUCAAUGA | 516 | UCAUUGAGAAACAUGCGCAGGAG | 1186 |
| 781 | siRNA122' | GGCAGAGAGCUUGAGGCACGA | 514 | UCGUGCCUCAAGCUCUCUGCCAG | 1187 |
| 602 | siRNA101' | AUGUUUGAAGCUGGGUAUUUA | 493 | UAAAUACCCAGCUUCAAACAUAG | 1188 |
| 1433 | siRNA260' | CAAUUUUUGAUUCUGAUGCUA | 652 | UAGCAUCAGAAUCAAAAAUUGAG | 1189 |
| 506 | siRNA81' | GAAAACCUCCAACGUAUCAUA | 473 | UAUGAUACGUUGGAGGUUUUCAG | 1190 |

*The ' after an siRNA# (e.g., siRNA#') indicates that the siRNA correspond to the same siRNA# in Table 5A, where the siRNA# and siRNA#' has the same sense strand nucleobase sequence, but the siRNA#' has the last two nucleobases of the antisense strand (counting 5'- 3') changed from"UU" to "AG", relative to siRNA#.
‡Each uracil base (U) in any one of the sequences provided in Table 7A may independently and optionally be replaced with a thymine base (T).

TABLE 7B

List of Chemically Modified Duplexes Prepared for the initial in vivo Screening‡

| Position | siRNA#* | Sense Strand Sequence | Nucleobase SEQ ID NO: | SEQ ID NO of modified sense strand: | Anti-Sense Strand Sequence | Nucleobase SEQ ID NO: | SEQ ID NO of modified antisense strand: |
|---|---|---|---|---|---|---|---|
| 223 | siRNA27'-M3^ | [mUs][mCs][mU][mU][mG][mA][mG][mU][fU][fC][fC][fU][mC][mA][mG][mA][mG][mC][mA][mA][mAs] | 419 | 1219 | [mUs][fUs][fU][mG][fC][fU][fC][fU][mG][fA][mG][mG][mA][fA][mC][mU][mC][mA][mA][mG][mAs][mAs][mG] | 1161 | 1989 |
| 844 | siRNA125'-M3 | [mGs][mCs][mG][mC][mA][mU][mG][mU][fU][fU][fC][fU][mC][mA][mA][mU][mG][mA][mC][mA][mAs] | 517 | 1329 | [mUs][fUs][fG][mU][fC][fA][fU][fU][mG][fA][mG][mA][mA][fA][mC][mA][mU][mG][mC][mG][mCs][mAs][mG] | 1162 | 1993 |
| 1417 | siRNA256'-M3 | [mUs][mAs][mU][mC][mC][mA][mC][mG][fA][fA][fA][fU][mC][mA][mA][mG][mC][mA][mA][mU][mAs] | 648 | 1474 | [mUs][fAs][fU][mU][fG][fC][fU][fU][mG][fA][mU][mU][mU][fC][mG][mU][mG][mG][mA][mU][mAs][mAs][mG] | 1163 | 1997 |
| 1039 | siRNA172'-M3 | [mAs][mAs][mA][mA][mG][mU][mC][mA][fG][fC][fU][fU][mG][mG][mA][mA][mG][mG][mC][mA][mAs] | 564 | 1379 | [mUs][fUs][fG][mC][fC][fU][fU][fC][mC][fA][mA][mG][mC][fU][mG][mA][mC][mU][mU][mU][mUs][mAs][mG] | 1164 | 1998 |
| 1227 | siRNA205'-M3 | [mUs][mAs][mG][mC][mU][mC][mU][mU][fU][fA][fC][fC][mC][mA][mC][mA][mG][mU][mU][mA][mAs] | 597 | 1417 | [mUs][fUs][fA][mA][fC][fU][fG][fU][mG][fG][mG][mU][mA][fA][mA][mG][mA][mG][mC][mU][mAs][mAs][mG] | 1165 | 1999 |
| 1084 | siRNA174'-M3 | [mAs][mCs][mU][mG][mA][mA][mU][mG][fA][fC][fC][fU][mG][mC][mC][mA][mG][mU][mA][mU][mAs] | 566 | 1382 | [mUs][fAs][fU][mA][fC][fU][fG][fG][mC][fA][mG][mG][mU][fC][mA][mU][mU][mC][mA][mG][mUs][mAs][mG] | 1166 | 2003 |
| 1011 | siRNA161'-M3 | [mUs][mGs][mA][mA][mA][mA][mG][mA][fA][fC][fA][fU][mU][mA][mG][mA][mG][mA][mA][mU][mAs] | 553 | 1367 | [mUs][fAs][fU][mU][fC][fU][fC][fU][mA][fA][mU][mG][mU][fU][mC][mU][mU][mU][mU][mC][mAs][mAs][mG] | 1167 | 2007 |
| 1191 | siRNA190'-M3 | [mAs][mGs][mG][mA][mC][mG][mG][mU][fU][fC][fC][fU][mA][mC][mA][mA][mC][mA][mU][mC][mAs] | 582 | 1399 | [mUs][fGs][fA][mU][fG][fU][fU][fG][mU][fA][mG][mG][mA][fA][mC][mC][mG][mU][mC][mC][mUs][mAs][mG] | 1168 | 2008 |

TABLE 7B-continued

List of Chemically Modified Duplexes Prepared for the initial in vivo Screening‡

| Position | siRNA#* | Sense Strand Sequence | Nucleobase SEQ ID NO: | SEQ ID NO of modified sense strand: | Anti-Sense Strand Sequence | Nucleobase SEQ ID NO: | SEQ ID NO of modified antisense strand: |
|---|---|---|---|---|---|---|---|
| 292 | siRNA47'-M3 | [mUs][mGs][mU][mC][mC][mA][mU][mU][fU][fC][fA][fU][mC][mA][mC][mA][mA][mA][mU][mC][mAs] | 439 | 1241 | [mUs][fGs][fA][mU][fU][fU][fG][fU][mG][fA][mU][mG][mA][fA][mA][mU][mG][mG][mA][mC][mAs][mAs][mG] | 1169 | 2009 |
| 673 | siRNA118'-M3 | [mUs][mCs][mU][mA][mA][mA][mC][mA][fA][fU][fC][fU][mU][mG][mA][mC][mA][mA][mC][mU][mAs] | 510 | 1319 | [mUs][fAs][fG][mU][fU][fG][fU][fC][mA][fA][mG][mA][mU][fU[mG][mU][mU][mU][mA][mG][mAs][mAs][mG] | 1170 | 2013 |
| 1298 | siRNA231'-M3 | [mAs][mGs][mG][mU][mA][mU][mC][mU][fU][fG][fA][fU][mG][mA][mA][mA][mA][mC][mG][mG][mAs] | 623 | 1447 | [mUs][fCs][fC][mG][fU][fU][fU][fU][mC][fA][mU][mC][mA][fA][mG][mA][mU][mA][mC][mC][mUs][mAs][mG] | 1171 | 2014 |
| 1561 | siRNA272'-M3 | [mAs][mUs][mA][mU][mA][mA][mA][mU][fU][fC][fA][fA][mG][mC][mA][mU][mU][mU][mG][mU][mAs] | 664 | 1492 | [mUs][fAs][fC][mA][fA][fA][fU][fG][mC][fU][mU][mG][mA][fA][mU][mU][mU][mA][mU][mA][mUs][mAs][mG] | 1172 | 2015 |
| 1237 | siRNA212'-M3 | [mCs][mCs][mC][mA][mC][mA][mG][mU][fU][fA][fA][fU][mG][mC][mA][mC][mU][mU][mA][mG][mAs] | 604 | 1425 | [mUs][fCs][fU][mA][fA][fG][fU][fG][mC][fA][mU][mU][mA][fA][mC][mU][mG][mU][mG][mG][mGs][mAs][mG] | 1173 | 2017 |
| 1228 | siRNA206'-M3 | [mAs][mGs][mC][mU][mC][mU][mU][mU][fA][fC][fC][fC][mA][mC][mA][mG][mU][mU][mA][mA][mAs] | 598 | 1418 | [mUs][fUs][fU][mA][fA][fC][fU][fG][mU][fG][mG][mG][mU][fA][mA][mA][mG][mA][mG][mC][mUs][mAs][mG] | 1174 | 2021 |
| 1386 | siRNA250'-M3 | [mGs][mAs][mG][mC][mU][mA][mC][mA][fA][fU][fA][fU][mG][mU][mC][mC][mU][mG][mG][mA][mAs] | 642 | 1467 | [mUs][fUs][fC][mC][fA][fG][fG][fA][mC][fA][mU][mA][mU][fU[mG][mU][mA][mG][mC][mU][mCs][mAs][mG] | 1175 | 2024 |
| 1217 | siRNA203'-M3 | [mGs][mAs][mU][mG][mA][mC][mA][mU][fC][fA][fU][fA][mG][mC][mU][mC][mU][mU][mU][mA][mAs] | 595 | 1414 | [mUs][fUs][fA][mA][fA][fG][fA][fG][mC][fU][mA][mU][mG][fA][mU][mG][mU][mC][mA][mU][mCs][mAs][mG] | 1176 | 2025 |

TABLE 7B-continued

List of Chemically Modified Duplexes Prepared for the initial in vivo Screening‡

| Position | siRNA#* | Sense Strand Sequence | Nucleobase SEQ ID NO: | SEQ ID NO of modified sense strand: | Anti-Sense Strand Sequence | Nucleobase SEQ ID NO: | SEQ ID NO of modified antisense strand: |
|---|---|---|---|---|---|---|---|
| 478 | siRNA73'-M3 | [mCs][mUs][mU][mG][mA][mA][mU][mU][fC][fC][fC][fU][mC][mA][mC][mG][mG][mA][mA][mA][mAs] | 465 | 1270 | [mUs][fUs][fU][mU][fC][fC][fG][fU][mG][fA][mG][mG][mG][fA][mA][mU][mU][mC][mA][mA][mGs][mAs][mG] | 1177 | 2026 |
| 595 | siRNA100'-M3 | [mCs][mCs][mG][mA][mG][mU][mG][mA][fU][fG][fU][fU][mU][mG][mA][mA][mG][mC][mU][mG][mAs] | 492 | 1299 | [mUs][fCs][fA][mG][fC][fU][fU][fC][mA][fA][mA][mC][mA][fU][mC][mA][mC][mU][mC][mG][mGs][mAs][mG] | 1178 | 2027 |
| 1291 | siRNA226'-M3 | [mAs][mUs][mA][mU][mG][mA][mU][mA][fG][fG][fU][fA][mU][mC][mU][mU][mG][mA][mU][mG][mAs] | 618 | 1441 | [mUs][fCs][fA][mU][fC][fA][fA][fG][mA][f][mA][mC][mC][fU][mA][mU][mC][mA][mU][mA][mUs][mAs][mG] | 1179 | 2028 |
| 115 | siRNA12'-M3 | [[mUs][mUs][mG][mU][mC][mU][mA][mU][fG][fG][fC][fU][mU][mA][mU][mU][mC][mU][mU][mG][mAs] | 404 | 1202 | [mUs][fCs][fA][mA][fG][fA][fA][fU][mA][fA][mG][mC][mC][fA][mU][mA][mG][mA][mC][mA][mAs][mAs][mG] | 1180 | 2029 |
| 477 | siRNA72'-M3 | [mCs][mCs][mU][mU][mG][mA][mA][mU][fU][fC][fC][fC][mU][mC][mA][mC][mG][mG][mA][mA][mAs] | 464 | 1267 | [mUs][fUs][fU][mC][fC][fG][fU][fG][mA][fG][mG][mG][mA][fA][mU][mU][mC][mA][mA][mG][mGs][mAs][mG] | 1181 | 2034 |
| 1005 | siRNA158'-M3 | [mAs][mAs][mG][mA][mA][mG][mU][mG][fA][fA][fA][fA][mG][mA][mA][mC][mA][mU][mU][mA][mAs] | 550 | 1363 | [mUs][fUs][fA][mA][fU][fG][fU][fU][mC][fU][mU][mU][mU][fC][mA][mC][mU][mU][mC][mU][mUs][mAs][mG] | 1182 | 2037 |
| 251 | siRNA38'-M3 | [mAs][mAs][mA][mC][mA][mU][mG][mG][fU][fC][fA][fU][mG][mU][mU][mU][mU][mU][mA][mC][mAs] | 430 | 1231 | [mUs][fGs][fU][mA][fA][fA][fA][fA][mC][fA][mU][mG][mA][fC][mC][mA][mU][mG][mU][mU][mUs][mAs][mG] | 1183 | 2038 |
| 303 | siRNA51'-M3 | [mUs][mCs][mA][mC][mA][mA][mA][mU][fC][fC][fC][fU][mU][mG][mU][mC][mA][mU][mA][mC][mAs] | 443 | 1246 | [mUs][fGs][fU][mA][fU][fG][fA][fC][mA][fA][mG][mG][mG][fA][mU][mU][mU][mG][mU][mG][mAs][mAs][mG] | 1184 | 2039 |

TABLE 7B-continued

List of Chemically Modified Duplexes Prepared for the initial in vivo Screening‡

| Position | siRNA#* | Sense Strand Sequence | Nucleobase SEQ ID NO: | SEQ ID NO of modified sense strand: | Anti-Sense Strand Sequence | Nucleobase SEQ ID NO: | SEQ ID NO of modified antisense strand: |
|---|---|---|---|---|---|---|---|
| 1209 | siRNA199'-M3 | [mUs][mCs][mC][mG][mA][mA][mA][mA][fG][fA][fU][fG][mA][mC][mA][mU][mC][mA][mU][mA][mAs] | 591 | 1409 | [mUs][fUs][fA][mU][fG][fA][fU][fG][mU][fC][mA][mU][mC][fU][mU][mU][mU][mC][mG][mG][mAs][mAs][mG] | 1185 | 2043 |
| 841 | siRNA124'-M3 | [mCs][mCs][mU][mG][mC][mG][mC][mA][fU][fG][fU][fU][mU][mC][mU][mC][mA][mA][mU][mG][mAs] | 516 | 1327 | [mUs][fCs][fA][mU][fU][fG][fA][fG][mA][fA][mA][mC][mA][fU[mG][mC][mG][mC][mA][mG][mGs][mAs][mG] | 1186 | 2044 |
| 781 | siRNA122'-M3 | [mGs][mGs][mC][mA][mG][mA][mG][mA][fG][fC][fU][fU][mG][mA][mG][mG][mC][mA][mC][mG][mAs] | 514 | 1324 | [mUs][fCs][fG][mU][fG][fC][fC][fU][mC][fA][mA][mG][mC][fU][mC][mU][mC][mU][mG][mC][mCs][mAs][mG] | 1187 | 2045 |
| 602 | siRNA101'-M3 | [mAs][mUs][mG][mU][mU][mU][mG][mA][fA][fG][fC][fU][mG][mG][mG][mU][mA][mU][mU][mU][mAs] | 493 | 1301 | [mUs][fAs][fA][mA][fU][fA][fC][fC][mC][fA][mG][mC][mU][fU][mC][mA][mA][mA][mC][mA][mUs][mAs][mG] | 1188 | 2046 |
| 1433 | siRNA260'-M3 | [mCs][mAs][mA][mU][mU][mU][mU][mU][fG][fA][fU][fU][mC][mU][mG][mA][mU][mG][mC][mU][mAs] | 652 | 1479 | [mUs][fAs][fG][mC][fA][fU][fC][fA][mG][fA][mA][mU][mC][fA][mA][mA][mA][mA][mU][mU][mGs][mAs][mG] | 1189 | 2050 |
| 506 | siRNA81'-M3 | [mGs][mAs][mA][mA][mA][mC][mC][mU][fC][fC][fA][fA][mC][mG][mU][mA][mU][mC][mA][mU][mAs] | 473 | 1279 | [mUs][fAs][fU][mG][fA][fU][fA][fC][mG][fU][mU][mG][mG][fA][mG][mG][mU][mU][mU][mU][mCs][mAs][mG] | 1190 | 2051 |

*siRNA# in Table 7B correspond to the siRNA# in Table 7A, but with "M3" added to indicate modification pattern ^M3 refers to modification pattern MOD3 as shown in FIG. 1; mA, mC, mG, and mU are 2'-O-methyl modified adenosine, cytidine, guanosine, and uridine, respectively; fA, fC, fG, and fU are 2'-fluoro modified adenosine, cytidine, guanosine, and uridine, respectively; and s is a phosphorothioate internucleoside linkage.

‡Each uracil base (U) in any one of the sequences provided in Table 7B may independently and optionally be replaced with a thymine base (T).

All siRNAs tested in this experiment are conjugated at the 3'terminal nucleoside of the sense strand to a targeting moiety comprising a structure of Formula ($Z^6$).

It is to be understood that the "s" of the 3'-terminal [mAs] of the sense strand corresponds to the phosphorothioate linkage of the first repeat unit (i.e., the repeat unit that is directly covalently linked to the 3'-O of the sugar moiety of the 3' terminal nucleoside of the sense strand) of a targeting moiety comprising a structure of Formula ($Z^6$).

AAV8-Human CYP7A1 Mouse Model

All animal studies were approved by the Institutional Animal Care and Use Committee at Takeda Development Center Americas. Mice were housed in a pathogen-free animal facility at 22° C. under controlled 12-hour light/12-hour dark cycle. All mice were kept on standard chow diet (PicoLab Rodent Diet 20-5053). Male C57Bl/6J mice, 8-10 weeks of age, were purchased from Jackson Laboratories (Sacrament, CA, USA). On day −7, animals received a single intravenous dose of $1\times10^{11}$ vector genome copies of adeno-associated virus (AAV8 serotype) containing the gene encoding for human CYP7A1. On day 0, animals received a single subcutaneous dose of conjugated siRNA (conjugated at the 3'terminal nucleoside of the sense strand to a targeting moiety comprising a structure of Formula ($Z^6$)). On day 7, day 14, or day 28, 30 mg of liver tissue was collected and snap frozen for RNA isolation and quantitative polymerase chain reaction (qPCR).

RNA Extraction from Liver Tissue and Real Time PCR

Total RNA was isolated from 30 mg pieces of frozen liver tissues using MagMAX mirVana Total RNA isolation kit (ThermoFisher). Quantitative PCR was carried out in duplicate with 50 ng of total RNA in 10 uL volume per well in 384-well plates using QuantiTect Multiplex RT-PCR (Qiagen) master mix and predesigned TaqMan primer and probes (ThermoFisher). Human CYP7A1 (Catalog #Hs00928359_g1) was used for target gene knockdown and endogenous control 18S (4319413E) was used as the reference gene. Relative gene expression was determined by using the delta-delta CT method, also known as the $2^{-\Delta\Delta ct}$ method.

Relative fold gene expression was calculated by the delta-delta Ct method, also known as the $2^{-\Delta\Delta ct}$ method. Fold change was multiplied by 100 to represent the data as percent (%) mRNA remaining. Results are presented in Table 8.

Statistical Analysis

Results were expressed as mean±SEM. Statistical analysis was performed using one-way ANOVA or two-way ANOVA followed, if significant, by post-hoc Dunnett's test. Non parametric tests like Mann-Whitney were used when the N was too small, or data did not follow Gaussian distribution. The difference was considered significant when p<0.05.

TABLE 8

Results of the Initial in vivo Screening in Mouse

| Position | siRNA#* | Mean % mRNA Remaining hAAV (3 mg/kg dose level, day 7) | Mean % Knockdown hAAV (3 mg/kg dose level, day 7) |
|---|---|---|---|
| 223 | siRNA27'-M3 | 26.2 | 73.8 |
| 844 | siRNA125'-M3 | 23.4 | 76.6 |
| 1417 | siRNA256'-M3 | 38.6 | 61.4 |
| 1039 | siRNA172'-M3 | 34.7 | 65.3 |
| 1227 | siRNA205'-M3 | 25.5 | 74.5 |
| 1084 | siRNA174'-M3 | 22 | 78 |
| 1011 | siRNA161'-M3 | 50.6 | 49.4 |
| 1191 | siRNA190'-M3 | 38.5 | 61.5 |
| 292 | siRNA47'-M3 | 34.6 | 65.4 |
| 673 | siRNA118'-M3 | 35.8 | 64.2 |
| 1298 | siRNA231'-M3 | 38.3 | 61.7 |
| 1561 | siRNA272'-M3 | 44.2 | 55.8 |
| 1237 | siRNA212'-M3 | 33.6 | 66.4 |
| 1228 | siRNA206'-M3 | 24 | 76 |
| 1386 | siRNA250'-M3 | 53.5 | 46.5 |
| 1217 | siRNA203'-M3 | 58 | 42 |
| 478 | siRNA73'-M3 | 48.7 | 51.3 |
| 595 | siRNA100'-M3 | 45.7 | 54.3 |
| 1291 | siRNA226'-M3 | 41.3 | 58.7 |
| 115 | siRNA12'-M3 | 29.4 | 70.6 |
| 477 | siRNA72'-M3 | 28.3 | 71.7 |
| 1005 | siRNA158'-M3 | 40.9 | 59.1 |
| 251 | siRNA38'-M3 | 42.8 | 57.2 |
| 303 | siRNA51'-M3 | 34.3 | 65.7 |
| 1209 | siRNA199'-M3 | 52 | 48 |
| 841 | siRNA124'-M3 | 35.2 | 64.8 |
| 781 | siRNA122'-M3 | 45.3 | 54.7 |
| 602 | siRNA101'-M3 | 35.3 | 64.7 |
| 1433 | siRNA260'-M3 | 56.2 | 43.8 |
| 506 | siRNA81'-M3 | 13.8 | 86.2 |

*The siRNA# in Table 8 corresponds to the siRNA# in Table 7B.

All siRNAs tested in this experiment are conjugated at the 3'terminal nucleoside of the sense strand to a targeting moiety comprising a structure of Formula ($Z^6$).

Second Screening

Twelve-siRNAs were selected based on their RNAi activity for further optimization. All these siRNA showed greater than 60% knockdown in a AAV model. Three (3) new modification patterns (MOD 1, MOD 2, and MOD 4, FIG. 1) were applied to these sequences (in addition to the modification pattern, MOD 3, used for the initial screening) to obtain 48-unique siRNAs (shown in Table 9).

TABLE 9

List of Chemically Modified Duplexes Prepared for the second in vivo Screening‡

| Position | siRNA# | Sense Strand Sequence | Nucleobase SEQ ID NO: | SEQ ID NO of modified sense strand: | Anti-Sense Strand Sequence | Nucleobase SEQ ID NO: | SEQ ID NO of modified antisense strand: |
|---|---|---|---|---|---|---|---|
| 223 | siRNA27'-M3^ | [mUs][mCs][mU][mU][mG][mA][mG][mU][fU][fC][fC][fU][mC][mA][mG][mA][mG][mC][mA][mA][mAs] | 419 | 1219 | [mUs][fUs][fU][mG][fC][fU][fC][fU][mG][fA][mG][mG][mA][fA][mC][mU][mC][mA][mA][mG][mAs][mAs][mG] | 1161 | 1989 |
| 844 | siRNA125'-M3 | [mGs][mCs][mG][mC][mA][mU][mG][mU][fU][fU][fC][fU][mC][mA][mA][mU][mG][mA][mC][mA][mAs] | 517 | 1329 | [mUs][fUs][fG][mU][fC][fA][fU][fU][mG][fA][mG][mA][mA][fA][mC][mA][mU][mG][mC][mG][mCs][mAs[mG] | 1162 | 1993 |
| 1227 | siRNA205'-M3 | [mUs][mAs][mG][mC][mU][mC][mU][mU][fU][fA][fC][fC][mC][mA][mC][mA][mG][mU][mU][mA][mAs] | 597 | 1417 | [mUs][fUs][fA][mA][fC][fU][fG][fU][mG][fG][mG][mU][mA][fA][mA][mG][mA][mG][mC][mU][mAs][mAs][mG] | 1165 | 1999 |
| 1084 | siRNA174'-M3 | [mAs][mCs][mU][mG][mA][mA][mU][mG][fA][fC][fC][fU][mG][mC][mC][mA][mG][mU][mA][mU][mAs] | 566 | 1382 | [mUs][fAs][fU][mA][fC][fU][fG][fG][mC][fA][mG][mG][mU][fC][mA][mU][mU][mC][mA][mG][mUs][mAs][mG] | 1166 | 2003 |
| 292 | siRNA47'-M3 | [mUs][mGs][mU][mC][mC][mA][mU][mU][fU][fC][fA][fU][mC][mA][mC][mA][mA][mA][mU][mC][mAs | 439 | 1241 | [mUs][fGs][fA][mU][fU][fU][fG][fU][mG][fA][mU][mG][mA][fA][mA][mU][mG][mG][mA][mC][mAs][mAs][mG] | 1169 | 2009 |
| 1237 | siRNA212'-M3 | [mCs][mCs][mC][mA][mC][mA][mG][mU][fU][fA][fA][fU][mG][mC][mA][mC][mU][mU][mA][mG][mAs | 604 | 1425 | [mUs][fCs][fU][mA][fA][fG][fU][fG][mC][fA][mU][mU][mA][fA][mC][mU][mG][mU][mG][mG][mGs][mAs][mG] | 1173 | 2017 |
| 1228 | siRNA206'-M3 | [mAs][mGs][mC][mU][mC][mU][mU][mU][fA][fC][fC][fC][mA][mC][mA][mG][mU][mU][mA][mA][mAs] | 598 | 1418 | [mUs][fUs][fU][mA][fA][fC][fU][fG][mU][fG][mG][mG][mU][fA][mA][mA][mG][mA][mG][mC][mUs][mAs][mG] | 1174 | 2021 |
| 115 | siRNA12'-M3 | [mUs][mUs][mG][mU][mC][mU][mA][mU][fG][fG][fC][fU][mU][mA][mU][mU][mC][mU][mU][mG][mAs] | 404 | 1202 | [mUs][fCs][fA][mA][fG][fA][fA][fU][mA][fA][mG][mC][mC][fA][mU][mA][mG][mA][mC][mA][mAs][mAs][mG] | 1180 | 2029 |

TABLE 9-continued

List of Chemically Modified Duplexes Prepared for the second in vivo Screening‡

| Position | siRNA# | Sense Strand Sequence | Nucleobase SEQ ID NO: | SEQ ID NO of modified sense strand: | Anti-Sense Strand Sequence | Nucleobase SEQ ID NO: | SEQ ID NO of modified antisense strand: |
|---|---|---|---|---|---|---|---|
| 477 | siRNA72'-M3 | [mCs][mCs][mU][mU][mG][mA][mA][mU][fU][fC][fC][fC][mU][mC][mA][mC][mG][mG][mA][mA][mAs] | 464 | 1267 | [mUs][fUs][fU][mC][fC][fG][fU][fG][mA][fG][mG][mG][mA][fA][mU][mU][mC][mA][mA][mG][mGs][mAs][mG] | 1181 | 2034 |
| 303 | siRNA51'-M3 | [[mUs][mCs][mA][mC][mA][mA][mA][mU][fC][fC][fC][fU][mU][mG][mU][mC][mA][mU][mA][mC][mAs | 443 | 1246 | [mUs][fGs][fU][mA][fU][fG][fA][fC][mA][fA][mG][mG][mG][fA][mU][mU][mU][mG][m][mG][mAs][mAs][mG] | 1184 | 2039 |
| 602 | siRNA101'-M3 | [mAs][mUs][mG][mU][mU][mU][mG][mA][fA][fG][fC][fU][mG][mG][mG][mU][mA][mU][mU][mU][mAs] | 493 | 1301 | [mUs][fAs][fA][mA][fU][fA][fC][fC][mC][fA][mG][mC][mU][fU][mC][mA][mA][mA][mC][mA][mUs][mAs] [mG] | 1188 | 2046 |
| 506 | siRNA81'-M3 | [mGs][mAs][mA][mA][mA][mC][mC][mU][fC][fC][fA][fA][mC][mG][mU][mA][mU][mC][mA][mU][mAs] | 473 | 1279 | [mUs][fAs][fU][mG][fA][fU][fA][fC][mG][fU][mU][mG][mG][fA][mG][mG][mU][mU][mU][mU][mCs][mAs][mG] | 1190 | 2051 |
| 844 | siRNA125'-M4 | [mGs][mCs][mG][mC][mA][mU][mG][mU][fU][fU][fC][fU][mC][mA][mA][mU][mG][mA][mC][mA][mAs] | 517 | 1329 | [mUs][fUs][fG][mU][mC][mA][fU][mU][mG][fA][mG][mA][mA][fA][mC][mA][mU][mG][mC][mG][mCs][mAs][mG] | 1162 | 1994 |
| 1227 | siRNA205'-M4 | [mUs][mAs][mG][mC][mU][mC][mU][mU][fU][fA][fC][fC][mC][mA][mC][mA][mG][mU][mU][mA][mAs] | 597 | 1417 | [mUs][fUs][fA][mA][mC][mU][fG][mU][mG][fG][mG][mU][mA][fA][mA][mG][mA][mG][mC][mU][mAs][mAs][mG] | 1165 | 2000 |
| 1084 | siRNA174'-M4 | [mAs][mCs][mU][mG][mA][mA][mU][mG][fA][fC][fC][fU][mG][mC][mC][mA][mG][mU][mA][mU][mAs] | 566 | 1382 | [mUs][fAs][fU][mA][mC][mU][fG][mG][mC][fA][mG][mG][mU][fC][mA][mU][mU][mC][mA][mG][mUs][mAs][mG] | 1166 | 2004 |
| 292 | siRNA47'-M4 | [mUs][mGs][mU][mC][mC][mA][mU][mU][fU][fC][fA][fU][mC][mA][mC][mA][mA][mA][mU][mC][mAs] | 439 | 1241 | [mUs][fGs][fA][mU][mU][mU][fG][mU][mG][fA][mU][mG][mA][fA][mA][mU][mG][mG][mA][mC][mAs][mAs][mG] | 1169 | 2010 |
| 1237 | siRNA212'-M4 | [mCs][mCs][mC][mA][mC][mA][mG][mU][fU][fA][fA][fU][mG][mC][mA][mC][mU][mU][mA][mG][mAs] | 604 | 1425 | [mUs][fCs][fU][mA][mA][mG][fU][mG][mC][fA][mU][mU][mA][fA][mC][mU][mG][mU][mG][mG][mGs][mAs][mG] | 1173 | 2018 |

TABLE 9-continued

List of Chemically Modified Duplexes Prepared for the second in vivo Screening‡

| Position | siRNA# | Sense Strand Sequence | Nucleobase SEQ ID NO: | SEQ ID NO of modified sense strand: | Anti-Sense Strand Sequence | Nucleobase SEQ ID NO: | SEQ ID NO of modified antisense strand: |
|---|---|---|---|---|---|---|---|
| 1228 | siRNA206'-M4 | [mAs][mGs][mC][mU][mC][mU][mU][mU][fA][fC][fC][fC][mA][mC][mA][mG][mU][mU][mA][mA][mAs] | 598 | 1418 | [mUs][fUs][fU][mA][mA][mC][fU][mG][mU][fG][mG][mG][mU][fA][mA][mA][mG][mA][mG][mC][mUs][mAs][mG] | 1174 | 2022 |
| 115 | siRNA12'-M4 | [mUs][mUs][mG][mU][mC][mU][mA][mU][fG][fG][fC][fU][mU][mA][mU][mU][mC][mU][mU][mG][mAs] | 404 | 1202 | [mUs][fCs][fA][mA][mG][mA][fA][mU][mA][fA][mG][mC][mC][fA][mU][mA][mG][mA][mC][mA][mAs][mAs][mG] | 1180 | 2030 |
| 477 | siRNA72'-M4 | [mCs][mCs][mU][mU][mG][mA][mA][mU][f][fC][fC][fC][mU][mC][mA][mC][mG][mG][mA][mA][mAs] | 464 | 1267 | [mUs][fUs][fU][mC][mC][mG][fU][mG][mA][fG][mG][mG][mA][fA][mU][mU][mC][mA][mA][mG][mGs][mAs][mG] | 1181 | 2035 |
| 303 | siRNA51'-M4 | [mUs][mCs][mA][mC][mA][mA][mA][mU][fC][fC][fC][fU][mU][mG][mU][mC][mA][mU][mA][mC][mAs] | 443 | 1246 | [mUs][fGs][fU][mA][mU][mG][fA][mC][mA][fA][mG][mG][mG][fA][mU][mU][mU][mG][mU][mG][mAs][mAs][mG] | 1184 | 2040 |
| 602 | siRNA101'-M4 | [mAs][mUs][mG][mU][mU][mU][mG][mA][fA][fG][fC][fU][mG][mG][mG][mU][mA][mU][mU][mU][mAs] | 493 | 1301 | [mUs][fAs][fA][mA][mU][mA][fC][mC][mC][fA][mG][mC][mU][fU][mC][mA][mA][mA][mC][mA][mUs][mAs][mG] | 1188 | 2047 |
| 506 | siRNA81'-M4 | [mGs][mAs][mA][mA][mA][mC][mC][mU][fC][fC][fA][fA][mC][mG][mU][mA][mU][mC][mA][mU][mAs] | 473 | 1279 | [mUs][fAs][fU][mG][mA][mU][fA][mC][mG][fU][mU][mG][mG][fA][mG][mG][mU][mU][mU][mU][mCs][mAs][mG] | 1190 | 2052 |
| 223 | siRNA27'-M4 | [mUs][mCs][mU][mU][mG][mA][mG][mU][fU][fC][fC][fU][mC][mA][mG][mA][mG][mC][mA][mA][mAs] | 419 | 1219 | [mUs][fUs][fU][mG][mC][mU][fC][mU][mG][fA][mG][mG][mA][fA][mC][mU][mC][mA][mA][mG][mAs][mAs][mG] | 1161 | 1990 |
| 844 | siRNA125'-M1 | [mGs][mCs][mG][mC][mA][mU][mG][mU][fU][fU][fC][fU][mC][mA][mA][mU][mG][mA][mC][mA][mAs] | 517 | 1329 | [mUs][fUs][fG][mU][fC][mA][fU][fU][mG][fA][mG][mA][mA][fA][mC][mA][mU][mG][mC][mG][mCs][mAs][mG] | 1162 | 1995 |
| 1227 | siRNA205'-M1 | [mUs][mAs][mG][mC][mU][mC][mU][mU][fU][fA][fC][fC][mC][mA][mC][mA][mG][mU][mU][mA][mAs] | 597 | 1417 | [mUs][fUs][fA][mA][fC][mU][fG][fU][mG][fG][mG][mU][mA][fA][mG][mA][mG][mC][mU][mAs][mAs][mG] | 1165 | 2001 |

TABLE 9-continued

List of Chemically Modified Duplexes Prepared for the second in vivo Screening‡

| Position | siRNA# | Sense Strand Sequence | Nucleobase SEQ ID NO: | SEQ ID NO of modified sense strand: | Anti-Sense Strand Sequence | Nucleobase SEQ ID NO: | SEQ ID NO of modified antisense strand: |
|---|---|---|---|---|---|---|---|
| 1084 | siRNA174'-M1 | [mAs][mCs][mU][mG][mA][mA][mU][mG][fA][fC][fC][fU][mG][mC][mC][mA][mG][mU][mA][mU][mAs] | 566 | 1382 | [mUs][fAs][fU][mA][fC][mU][fG][fG][mC][fA][mG][mG][mU][fC][mU][mU][mC][mA][mG][mUs][mAs][mG] | 1166 | 2005 |
| 292 | siRNA47'-M1 | [mUs][mGs][mU][mC][mC][mA][mU][mU][fU][fC][fA][fU][mC][mA][mC][mA][mA][mA][mU][mC][mAs] | 439 | 1241 | [mUs][fGs][fA][mU][fU][mU][fG][fU][mG][fA][mU][mG][mA][fA][mU][mG][mG][mA][mC][mAs][mAs][mG] | 1169 | 2011 |
| 1237 | siRNA212'-M1 | [mCs][mCs][mC][mA][mC][mA][mG][mU][fU][fA][fA][fU][mG][mC][mA][mC][mU][mU][mA][mG][mAs] | 604 | 1425 | [mUs][fCs][fU][mA][fA][mG][fU][fG][mC][fA][mU][mU][mA][fA][mC][mU][mG][mU][mG][mG][mGs][mAs][mG] | 1173 | 2016 |
| 1228 | siRNA206'-M1 | [mAs][mGs][mC][mU][mC][mU][mU][mU][fA][fC][fC][fC][mA][mC][mA][mG][mU][mU][mA][mA][mAs] | 598 | 1418 | [mUs][fUs][fU][mA][fA][mC][fU][fG][mU][fG][mG][mG][mU][fA][mA][mG][mA][mG][mC][mUs][mAs][mG] | 1174 | 2020 |
| 115 | siRNA12'-M1 | [mUs][mUs][mG][mU][mC][mU][mA][mU][fG][fG][fC][fU][mU][mA][mU][mU][mC][mU][mU][mG][mAs] | 404 | 1202 | [mUs][fCs][fA][mA][fG][mA][fA][fU][mA][fA][mG][mC][mC][fA][mU][mA][mG][mA][mC][mA][mAs][mAs][mG] | 1180 | 2031 |
| 477 | siRNA72'-M1 | [mCs][mCs][mU][mU][mG][mA][mA][mU][fU][fC][fC][fC][mU][mC][mA][mC][mG][mG][mA][mA][mAs] | 464 | 1267 | [mUs][fUs][fU][mC][fC][mG][fU][fG][mA][fG][mG][mG][mA][fA][mU][mU][mC][mA][mA][mG][mGs][mAs][mG] | 1181 | 2036 |
| 303 | siRNA51'-M1 | [mUs][mCs][mA][mC][mA][mA][mA][mU][fC][fC][fC][fU][mU][mG][mU][mC][mA][mU][mA][mC][mAs] | 443 | 1246 | [mUs][fGs][fU][mA][fU][mG][fA][fC][mA][fA][mG][mG][mG][fA][mU][mU][mU][mG][mU][mG][mAs][mAs][mG] | 1184 | 2041 |
| 602 | siRNA101'-M1 | [mAs][mUs][mG][mU][mU][mU][mG][mA][fA][fG][fC][fU][mG][mG][mG][mU][mA][mU][mU][mU][mAs] | 493 | 1301 | [mUs][fAs][fA][mA][fU][mA][fC][fC][mC][fA][mG][mC][mU][fU][mC][mA][mA][mA][mC][mA][mUs][mAs][mG] | 1188 | 2048 |
| 506 | siRNA81'-M1 | [mGs][mAs][mA][mA][mA][mC][mC][mU][fC][fC][fA][fA][mC][mG][mU][mA][mU][mC][mA][mU][mAs] | 473 | 1279 | [mUs][fAs][fU][mG][fA][mU][fA][fC][mG][fU][mU][mG][mG][fA][mG][mG][mU][mU][mU][mU][mCs][mAs][mG] | 1190 | 2053 |

TABLE 9-continued

List of Chemically Modified Duplexes Prepared for the second in vivo Screening‡

| Position | siRNA# | Sense Strand Sequence | Nucleobase SEQ ID NO: | SEQ ID NO of modified sense strand: | Anti-Sense Strand Sequence | Nucleobase SEQ ID NO: | SEQ ID NO of modified antisense strand: |
|---|---|---|---|---|---|---|---|
| 223 | siRNA27'-M1 | [mUs][mCs][mU][mU][mG][mA][mG][mU][fU][fC][fC][fU][mC][mA][mG][mA][mG][mC][mA][mA][mAs] | 419 | 1219 | [mUs][fUs][fU][mG][fC][mU][fC][fU][mG][fA][mG][mG][mA][fA][mC][mU][mC][mA][mA][mG][mAs][mAs][mG] | 1161 | 1991 |
| 844 | siRNA125'-M2 | [mGs][mCs][mG][mC][mA][mU][mG][mU][fU][fU][fC][fU][mC][mA][mA][mU][mG][mA][mC][mA][mAs] | 517 | 1329 | [mUs][fUs][fG][mU][fC][fA][fU][mU][mG][fA][mG][mA][mA][fA][mC][mA][mU][mG][mC][mG][mCs][mAs][mG] | 1162 | 1996 |
| 1227 | siRNA205'-M2 | [mUs][mAs][mG][mC][mU][mC][mU][mU][fU][fA][fC][fC][mC][mA][mC][mA][mG][mU][mU][mA][mAs] | 597 | 1417 | [mUs][fUs][fA][mA][fC][fU][fG][mU][mG][fG][mG][mU][mA][fA][mG][mA][mG][mC][mU][mAs][mAs][mG] | 1165 | 2002 |
| 1084 | siRNA174'-M2 | [mAs][mCs][mU][mG][mA][mA][mU][mG][fA][fC][fC][fU][mG][mC][mC][mA][mG][mU][mA][mU][mAs] | 566 | 1382 | [mUs][fAs][fU][mA][fC][fU][fG][mG][mC][fA][mG][mG][mU][fC][mU][mU][mC][mA][mG][mUs][mAs][mG] | 1166 | 2006 |
| 292 | siRNA47'-M2 | [mUs][mGs][mU][mC][mC][mA][mU][mU][fU][fC][fA][fU][mC][mA][mC][mA][mA][mA][mU][mC][mAs] | 439 | 1241 | [mUs][fGs][fA][mU][fU][fU][fG][mU][mG][fA][mU][mG][mA][fA][mU][mG][mG][mA][mC][mAs][mAs][mG] | 1169 | 2012 |
| 1237 | siRNA212'-M2 | [mCs][mCs][mC][mA][mC][mA][mG][mU][fU][fA][fA][fU][mG][mC][mA][mC][mU][mU][mA][mG][mAs] | 604 | 1425 | [mUs][fCs][fU][mA][fA][fG][fU][mG][mC][fA][mU][mU][mA][fA][mC][mU][mG][mU][mG][mG][mGs][mAs][mG] | 1173 | 2019 |
| 1228 | siRNA206'-M2 | [mAs][mGs][mC][mU][mC][mU][mU][mU][fA][fC][fC][fC][mA][mC][mA][mG][mU][mU][mA][mA][mAs] | 598 | 1418 | [mUs][fUs][fU][mA][fA][fC][fU][mG][mU][fG][mG][mG][mU][fA][mA][mG][mA][mG][mC][mUs][mAs][mG] | 1174 | 2023 |
| 115 | siRNA12'-M2 | [mUs][mUs][mG][mU][mC][mU][mA][mU][fG][fG][fC][fU][mU][mA][mU][mU][mC][mU][mU][mG][mAs] | 404 | 1202 | [mUs][fCs][fA][mA][fG][fA][fA][mU][mA][fA][mG][mC][mC][fA][mU][mA][mG][mA][mC][mA][mAs][mAs][mG] | 1180 | 2032 |
| 477 | siRNA72'-M2 | [mCs][mCs][mU][mU][mG][mA][mA][mU][fU][fC][fC][fC][mU][mC][mA][mC][mG][mG][mA][mA][mAs] | 464 | 1267 | [mUs][fUs][fU][mC][fC][fG][fU][mG][mA][fG][mG][mG][mA][fA][mU][mU][mC][mA][mA][mG][mGs][mAs][mG] | 1181 | 2033 |

TABLE 9-continued

List of Chemically Modified Duplexes Prepared for the second in vivo Screening‡

| Position | siRNA# | Sense Strand Sequence | Nucleobase SEQ ID NO: | SEQ ID NO of modified sense strand: | Anti-Sense Strand Sequence | Nucleobase SEQ ID NO: | SEQ ID NO of modified antisense strand: |
|---|---|---|---|---|---|---|---|
| 303 | siRNA51'-M2 | [mUs][mCs][mA][mC][mA][mA][mA][mU][fC][fC][fC][fU][mU][mG][mU][mC][mA][mU][mA][mC][mAs] | 443 | 1246 | [mUs][fGs][fU][mA][fU][fG][fA][mC][mA][fA][mG][mG][mG][fA][mU][mU][mU][mG][mU][mG][mAs][mAs][mG] | 1184 | 2042 |
| 602 | siRNA101'-M2 | [mAs][mUs][mG][mU][mU][mU][mG][mA][fA][fG][fC][fU][mG][mG][mG][mU][mA][mU][mU][mU][mAs] | 493 | 1301 | [mUs][fAs][fA][mA][fU][fA][fC][mC][mC][fA][mG][mC][mU][fU][mC][mA][mA][mA][mC][mA][mUs][mAs][mG] | 1188 | 2049 |
| 506 | siRNA81'-M2 | [mGs][mAs][mA][mA][mA][mC][mC][mU][fC][fC][fA][fA][mC][mG][mU][mA][mU][mC][mA][mU][mAs] | 473 | 1279 | [mUs][fAs][fU][mG][fA][fU][fA][mC][mG][fU][mU][mG][mG][fA][mG][mG][mU][mU][mU][mU][mCs][mAs][mG] | 1190 | 2054 |
| 223 | siRNA27'-M2 | [mUs][mCs][mU][mU][mG][mA][mG][mU][fU][fC][fC][fU][mC][mA][mG][mA][mG][mC][mA][mA][mAs] | 419 | 1219 | [mUs][fUs][fU][mG][fC][fU][fC][mU][mG][fA][mG][mG][mA][fA][mC][mU][mC][mA][mA][mG][mAs][mAs][mG] | 1161 | 1992 |

*The siRNA# corresponds to the siRNA# in Table 7A with different M# to indicate different modification patterns applied to the same nucleobase sequences.

All siRNAs tested in this experiment are conjugated at the 3'terminal nucleoside of the sense strand to a targeting moiety comprising a structure of Formula ($Z^6$). It is to be understood that the "s" of the 3'-terminal [mAs] of the sense strand corresponds to the phosphorothioate linkage of the first repeat unit (i.e., the repeat unit that is directly
covalently linked to the 3'-O of the sugar moiety of the 3' terminal nucleoside of the sense strand) of a targeting moiety comprising a structure of Formula ($Z^6$).

^M1, M2, M3, and M4 refer to modification patterns MOD1, MOD2, MOD3, and MOD4, respectively, as shown in FIG. 1; mA, mC, mG, and mU are 2'-O-methyl modified adenosine, cytidine, guanosine, and uridine, respectively; fA, fC, fG, and fU are 2'-fluoro modified adenosine, cytidine, guanosine, and uridine, respectively; and s is a phosphorothioate internucleoside linkage.

‡Each uracil base (U) in any one of the sequences provided in Table 9 may independently and optionally be replaced with a thymine base (T).

Table 10 summarizes the second in vivo screening results.

TABLE 10

| Results of the Second in vivo Screening in Mouse | | | |
|---|---|---|---|
| | siRNA # | Mean % mRNA Remaining hAAV (2 mg/kg dose level, day 14) | Mean % mRNA Remaining hAAV (2 mg/kg dose level, day 28) |
| 844 | siRNA125'-M3 | 53.3 | 42.8 |
| 1227 | siRNA205'-M3 | 44.9 | 57.5 |
| 1084 | SIRNA174'-M3 | 93.6 | 56.8 |
| 292 | siRNA-47'-M3 | 63.2 | 40.2 |
| 1237 | siRNA212'-M3 | 38.1 | 31.8 |
| 1228 | siRNA206'-M3 | 49.8 | 39.2 |
| 115 | siRNA12'-M3 | 57.0 | 49.1 |
| 477 | siRNA72'-M3 | 44.2 | 19.7 |
| 303 | siRNA51'-M3 | 48.5 | 32.5 |
| 602 | siRNA101'-M3 | 71.4 | 62.8 |
| 506 | siRNA81'-M3 | 43.4 | 61.4 |
| 223 | siRNA27'-M3 | 40.1 | 37.5 |
| 844 | siRNA125'-M4 | 51.4 | 50.9 |
| 1227 | siRNA205'-M4 | 96.0 | 63.9 |
| 1084 | siRNA174'-M4 | 85.5 | 52.2 |
| 292 | siRNA47'-M4 | 39.0 | 37.7 |
| 1237 | siRNA212'-M4 | 46.9 | 23.4 |
| 1228 | siRNA206'-M4 | 61.7 | 70.3 |
| 115 | siRNA12'-M4 | 57.9 | 31.8 |
| 477 | siRNA72'-M4 | 61.3 | 39.5 |
| 303 | siRNA51'-M4 | 49.0 | 33.5 |
| 602 | siRNA101'-M4 | 76.7 | 69.4 |
| 506 | siRNA81'-M4 | 51.1 | 41.7 |
| 223 | siRNA27'-M4 | 69.5 | 51.8 |
| 844 | siRNA125'-M1 | 35.5 | 45.4 |
| 1227 | siRNA205'-M1 | 70.1 | 76.7 |
| 1084 | siRNA174'-M1 | 57.6 | 89.2 |
| 292 | siRNA47'-M1 | 49.3 | 63.5 |
| 1237 | siRNA212'-M1 | 36.9 | 35.3 |
| 1228 | siRNA206'-M1 | 72.8 | 88.2 |
| 115 | siRNA12'-M1 | 35.9 | 38.8 |
| 477 | siRNA72'-M1 | 31.3 | 28.3 |
| 303 | siRNA51'-M1 | 27.5 | 35.8 |
| 602 | siRNA101'-M1 | 57.3 | 85.3 |
| 506 | siIRNA81'-M1 | 46.4 | 52.8 |
| 223 | siRNA27'-M1 | 51.5 | 73.1 |
| 844 | siRNA125'-M2 | 32.8 | 50.2 |
| 1227 | siRNA205'-M2 | 76.5 | 86.1 |
| 1084 | siRNA174'-M2 | 77.0 | 90.7 |
| 292 | siRNA47'-M2 | 31.1 | 65.3 |

TABLE 10-continued

| Results of the Second in vivo Screening in Mouse | | | |
|---|---|---|---|
| | siRNA # | Mean % mRNA Remaining hAAV (2 mg/kg dose level, day 14) | Mean % mRNA Remaining hAAV (2 mg/kg dose level, day 28) |
| 1237 | siRNA212'-M2 | 45.3 | 67.7 |
| 1228 | siRNA206'-M2 | 39.4 | 87.4 |
| 115 | siRNA12'-M2 | 29.3 | 42.6 |
| 477 | siRNA72'-M2 | 29.9 | 71.5 |
| 303 | siRNA51'-M2 | 28.3 | 43.7 |
| 602 | siRNA101'-M2 | 42.5 | 81.8 |
| 506 | siRNA81'-M2 | 53.1 | 53.9 |
| 223 | siRNA27'-M2 | 44.7 | 50.4 |

* The siRNA# corresponds to the siRNA# in Table 9. All siRNAs tested in this experiment are conjugated at the 3'terminal nucleoside of the sense strand to a targeting moiety comprising a structure of Formula ($Z^6$).

Example 5: In Vivo Efficacy in ANIT Cholestasis Model

Mouse cross-reactive sequence siRNA206'-M1 was used to demonstrate efficacy in a mouse model of cholestasis. α-naphthylisothiocyanate (ANIT) is a commonly used chemical to induce intrahepatic cholestasis modeling human disease. C57Bl/6 mice were administered siRNA206'-M1 on day 1, 8, and 15. ANIT was administered at 60 mg/kg by oral gavage on day 18. Serum chemistry, gene expression, and 7α-hydroxy-4-cholesten-3-one (C4) biomarker analyses were performed on day 21. Gene expression data was represented as fold change over vehicle group using the delta Ct method.

The results showed that the inhibition of CYP7A1 expression in hepatocytes leads to reduction in cholestasis. As shown in Tables 11 and 12, treatment with siRNA206'-M1 resulted in the reduction in serum bile acids and liver injury markers ALP, AST, ALT, and bilirubin, indicating the decrease in liver injury. Cholestasis induced the expression of pro-fibrotic genes col1a1, timp1, and ccl2 as well as bile acid transport genes ostb, ntcp, and bsep while treatment with siRNA206'-M1 normalized expression of these genes to near healthy control levels. Reduction of circulating CYP7A1 biomarker, serum C4, indicated inhibition of the target gene.

TABLE 11

| Serum Chemistry of ANIT Cholestasis Mice under Treatment | | | | | | |
|---|---|---|---|---|---|---|
| Group | ALP (U/L) ± sem | AST (U/L) ± sem | ALT (U/L) ± sem | Bilirubin (mg/dL) ± sem | C4 (ng/mL) ± sem | Bile Acids (umol/L) ± sem |
| Vehicle | 289.3 ± 39.93 | 4512 ± 1068 | 2432 ± 818.8 | 19.78 ± 2.17 | 60.0 ± 14.13 | 1769 ± 306.8 |
| siRNA206'-M1 | 38.5 ± 8.36 | 178.8 ± 52.0 | 142.5 ± 47.22 | 0.28 ± 0.75 | 15.66 ± 2.3 | 21.97 ± 8.50 |
| Healthy control | 23.6 ± 5.87 | 79.8 ± 18.2 | 27 ± 2.83 | 0.16 ± 0.02 | 41.2 ± 5.6 | 8.7 ± 0.96 |

TABLE 12

| Gene Express Profile of ANIT Cholestasis Mice under Treatment | | | | | | |
|---|---|---|---|---|---|---|
| Group | Col1a1 ± sem | Timp1 ± sem | Ccl2 ± sem | Ostb ± sem | Ntcp ± sem | Bsep ± sem |
| Vehicle | 1.11 ± 0.22 | 1.04 ± 0.13 | 1.008 ± 0.06 | 1.01 ± 0.08 | 1.04 ± 0.12 | 1.04 ± 0.14 |
| siRNA206'-M1 | 0.50 ± 0.21 | 0.19 ± 0.11 | 0.12 ± 0.05 | 0.04 ± 0.03 | 2.94 ± 0.32 | 0.78 ± 0.08 |
| Healthy control | 0.09 ± 0.02 | 0.005 ± 0.0008 | 0.014 ± 0.003 | 0.006 ± 0.001 | 3.39 ± 0.17 | 0.87 ± 0.05 |

Example 6: In Vitro RNAi Activity in HepaRG Human Hepatic Cell Line

To assess the efficacy and potency of sequences against the human CYP7A1 transcript, an in vitro dose response study was performed in the HepaRG human hepatic cell line. HepaRG cells are widely considered a robust surrogate for primary human hepatocytes due to similar expression profile, unlike other hepatic cell lines which have lost major liver-like functions.

Four (4) siRNA constructs, conjugated siRNA212'-M1, conjugated siRNA206'-M1, conjugated siRNA72'-M2, or conjugated siRNA12'-M3 (shown in Table 13), were tested in HepaRG cells. HepaRG cells were plated in a 96-well plate at 60,000 cells/well containing antibiotic-free medium and placed at 37° C. in an atmosphere with 5% $CO_2$ in a humidified incubator. Within 24 hours after seeding, cells were transfected with biological triplicates for each treatment. A 5-fold, 11-point dose response with a top dose of 1 μM of CYP7A1 siRNA constructs were applied to the cells following the manufacturer's recommendation (Thermofisher) for Lipofectamine RNAiMax. Cells were returned to the incubator for 48 hours with a medium change at 24 hours. Cell lysates were prepared 48 hours post-transfection by removing medium and washing with cold PBS and the addition of lysis buffer (following the manufacturer's recommendation for Cells-to-CT 1-step TaqMan Kit, Thermofisher). Reverse transcription was performed on cell lysates which were then used for qPCR. qPCR was performed in duplicate for each sample in a 10 μl reaction mix, multiplexing the probe for CYP7A1 with the housekeeping gene probe (GAPDH): Nuclease-free water 5.5 μl+qRT-PCR Master Mix 2.5 μl+TaqMan Primer-1, 0.5 μl+TaqMan Primer-2, 0.5 μl.

For each well, the target mRNA level was normalized to the respective GAPDH mRNA level and relative expression was calculated based on mock transfection control wells. Dose response curves were generated in GraphPad Prism and used to calculate half-maximal inhibitory concentrations (IC50) and maximal gene knockdown of a given siRNA construct. Table 14 summarizes the in vitro screening results.

TABLE 13

Chemically Modified Duplexes Prepared for the in vitro HepaRG Cell Study‡

| Position | siRNA #* | Sense Strand Sequence | Nucleobase SEQ ID NO: | SEQ ID NO of modified sense strand: | Anti-Sense Strand Sequence | Nucleobase SEQ ID NO: | SEQ ID NO of modified antisense strand: |
|---|---|---|---|---|---|---|---|
| 1237 | siRNA212'-M1 | [mCs][mCs][mC][mA][mC][mA][mG][mU][fU][fA][fA][fU][mG][mC][mA][mC][mU][mU][mA][mG][mAs] | 604 | 1425 | [mUs][fCs][fU][mA][fA][mG][fU][fG][mC][fA][mU][mU][mA][fA][mC][mU][mG][mU][mG][mG][mGs][mAs][mG] | 1173 | 2016 |
| 1228 | siRN A206'-M1 | [mAs][mGs][mC][mU][mC][mU][mU][mU][fA][fC][fC][fC][mA][mC][mA][mG][mU][mU][mA][mA][mAs] | 598 | 1418 | [mUs][fUs][fU][mA][fA][mC][fU][fG][mU][fG][mG][mG][mU][fA][mA][mA][mG][mA][mG][mC][mUs][mAs][mG] | 1174 | 2020 |
| 477 | siRNA72'-M2 | [mCs][mCs][mU][mU][mG][mA][mA][mU][fU][fC][fC][fC][mU][mC][mA][mC][mG][mG][mA][mA][mAs] | 464 | 1267 | [mUs][fUs][fU][mC][fC][fG][fU][mG][mA][fG][mG][mG][mA][fA][mU][mU][mC][mA][mA][mG][mGs][mAs][mG] | 1181 | 2033 |
| 115 | siRNA12'-M3 | [mUs][mUs][mG][mU][mC][mU][mA][mU][fG][fG][fC][fU][mU][mA][mU][mU][mC][mU][mU][mG][mAs] | 404 | 1202 | [mUs][fCs][fA][mA][fG][fA][fA][fU][mA][fA][mG][mC][mC][fA][mU][mA][mG][mA][mC][mA][mAs][mAs][mG] | 1180 | 2029 |

*The siRNA# corresponds to the siRNA# in Table 9.

All siRNAs tested in this experiment are conjugated at the 3'terminal nucleoside of the sense strand to a targeting moiety comprising a structure of Formula ($Z^6$). It is to be understood that the "s" of the 3'-terminal [mAs] of the sense strand corresponds to the phosphorothioate linkage of the first repeat unit (i.e., the repeat unit that is directly covalently linked to the 3'-O of the sugar moiety of the 3' terminal nucleoside of the sense strand) of a targeting moiety comprising a structure of Formula ($Z^6$).

‡Each uracil base (U) in any one of the sequences provided in Table 12 may independently and optionally be replaced with a thymine base (T).

TABLE 14

| In vitro Screening of siRNAs in HepaRG Human Hepatic Cell Line | | | |
|---|---|---|---|
| Position | siRNA#* | IC50 (nM) | Maximum mRNA knockdown (%) |
| 1237 | siRNA212'-M1 | 0.16 | 69 |
| 1228 | siRNA206'-M1 | 0.24 | 78 |
| 115 | siRNA12'-M3 | 0.34 | 72 |
| 477 | siRNA72'-M2 | 0.52 | 61 |

*The siRNA# corresponds to the siRNA# in Table 13. All siRNAs tested in this experiment are conjugated at the 3'terminal nucleoside of the sense strand to a targeting moiety comprising a structure of Formula ($Z^{6}$).

Example 7: In Vivo Study of siRNA Agents in Non-Human Primate (NHP)

The same four (4) siRNAs from Example 6 were tested in a single injection, single dose level (20 mg/kg), 56-day duration study in cynomolgus monkeys (*Macaca fascicularis*). The research protocol and animal housing were approved by the IACUC of Huazhen Laboratory Animal Breeding Center, Guangzhou China. Briefly, healthy naïve male cynomolgus monkeys 3-5 years of age were individually housed in a controlled environment with 12:12-h light: darkness cycle, controlled humidity range of 60-80% and temperature maintained in the range of 18-26° C. Animals were fed twice a day (BID) with a snack in between meals and had free access to drinking water. Animals were acclimated to all experimental procedures prior to study initiation. Vehicle, conjugated siRNA212'-M1, conjugated siRNA206'-M1, conjugated siRNA72'-M2, or conjugated siRNA12'-M3 (shown in Table 13) was administered in a single subcutaneous injection on day 0. Blood samples were collected at pre-dose day −7 and on days 7, 14, 21, 28, 35, 42, 49, and 56. All samples were analyzed for serum 7α-hydroxy-4-cholesten-3-one (C4), total bile acid, and cholic acid levels by mass spectrometry. C4 data are represented as percent reduction relative to vehicle group while total bile acid and cholic acid are represented percent reduction relative to pre-treatment samples.

Target engagement and pathway modulation were assessed by quantitation of serum C4 and the primary bile acid, cholic acid. Around 40-60% decrease in plasma C4 level was observed. Around 35-90% decrease in total bile acid, and around 40-97% decrease in cholic acid was observed.

ADDITIONAL EMBODIMENTS

1. An RNAi agent for inhibiting expression of Cytochrome P450 family 7 subfamily A member 1 (CYP7A1) in a cell, wherein the RNAi agent comprises a sense strand and an antisense strand forming a duplex region, wherein the antisense strand comprises a region of complementarity of at least 15 nucleosides to a CYP7A1 target sequence in Table 2, wherein the region of complementarity comprises a nucleoside sequence that contains no more than 3 mismatches to the CYP7A1 target sequence, and wherein the sense strand is at least substantially complementary to the antisense strand.

2. An RNAi agent for inhibiting expression of Cytochrome P450 family 7 subfamily A member 1 (CYP7A1) in a cell, wherein the RNAi agent comprises a sense strand and an antisense strand forming a duplex region, wherein the antisense strand comprises a region of complementarity of at least 15 nucleosides to a CYP7A1 target sequence of nucleotides 113-133, 221-241, 249-269, 290-310, 301-321, 475-495, 476-496, 504-524, 593-613, 600-620, 671-691, 779-799, 839-859, 842-862, 1003-1023, 1009-1029, 1037-1057, 1082-1102, 1189-1209, 1207-1227, 1215-1235, 1225-1245, 1226-1246, 1235-1255, 1289-1309, 1296-1316, 1384-1404, 1415-1435, 1431-1451, or 1559-1579 of SEQ ID NO: 1, wherein the region of complementarity comprises a nucleoside sequence that contains no more than 3 mismatches to the CYP7A1 target sequence, and wherein the sense strand is at least substantially complementary to the antisense strand.

3. The RNAi agent of embodiment 1 or embodiment 2, wherein the antisense strand comprises at least 15 consecutive nucleobases of any one of SEQ ID NOs: 777-1190.

4. The RNAi agent of any one of embodiments 1-3, wherein the sense strand comprises at least 15 consecutive nucleobases of any one of SEQ ID NOs: 393-776.

5. The RNAi agent of any one of embodiments 1-4, wherein the sense strand is 21 nucleosides in length and the antisense strand is 23 nucleosides in length, optionally wherein the RNAi agent comprises a 3' overhang of at least 1 nucleoside on a least one strand.

6. The RNAi agent of any one of embodiments 1-4, wherein the antisense strand comprises nucleobases 2-21 (counting 5'→3') of any one of SEQ ID NOs: 777-1190 and the sense strand comprises the nucleobase sequence of any one of SEQ ID NOs: 393-776.

7. The RNAi agent of any one of embodiments 1-6, wherein the antisense strand comprises the nucleobase sequence of any one of SEQ ID NOs: 777-1190 and the sense strand comprises the nucleobase sequence of any one of SEQ ID NOs: 393-776.

8. The RNAi agent of any one of embodiments 1-7, wherein the RNAi agent comprises the nucleobases sequences of an siRNA selected from siRNA1-siRNA384, siRNA12', siRNA27', siRNA38', siRNA47', siRNA51', siRNA72', siRNA73', siRNA81', siRNA100', siRNA101', siRNA118', siRNA122', siRNA124', siRNA125', siRNA158', siRNA161', siRNA172', siRNA174', siRNA190', siRNA199', siRNA203', siRNA205', siRNA206', siRNA212', siRNA226', siRNA231', siRNA250', siRNA256', siRNA260', and siRNA272'.

9. The RNAi agent of any one of embodiments 1-7, wherein the antisense strand comprises a nucleobase sequence selected from (5'→3'):

```
                                    (SEQ ID NO: 1161)
(i)          UUUGCUCUGAGGAACUCAAGAAG

                                    (SEQ ID NO: 1162)
(ii)         UUGUCAUUGAGAAACAUGCGCAG

                                    (SEQ ID NO: 1165)
(iii)        UUAACUGUGGGUAAAGAGCUAAG

                                    (SEQ ID NO: 1166)
(iv)         UAUACUGGCAGGUCAUUCAGUAG

                                    (SEQ ID NO: 1169)
(v)          UGAUUUGUGAUGAAAUGGACAAG

                                    (SEQ ID NO: 1173)
(vi)         UCUAAGUGCAUUAACUGUGGGAG

                                    (SEQ ID NO: 1174)
(vii)        UUUAACUGUGGGUAAAGAGCUAG
```

-continued

| | | |
|---|---|---|
| (viii) | UCAAGAAUAAGCCAUAGACAAAG | (SEQ ID NO: 1180) |
| (ix) | UUUCCGUGAGGGAAUUCAAGGAG | (SEQ ID NO: 1181) |
| (x) | UGUAUGACAAGGGAUUUGUGAAG | (SEQ ID NO: 1184) |
| (xi) and | UAAAUACCCAGCUUCAAACAUAG; | (SEQ ID NO: 1188) |
| (xii) | UAUGAUACGUUGGAGGUUUUCAG. | (SEQ ID NO: 1190) |

10. The RNAi agent of embodiment 9, wherein the sense strand comprises a nucleobase sequence selected from (5'→3'):

| | | |
|---|---|---|
| (i) | UCUUGAGUUCCUCAGAGCAAA; | (SEQ ID NO: 419) |
| (ii) | GCGCAUGUUUCUCAAUGACAA; | (SEQ ID NO: 517) |
| (iii) | UAGCUCUUUACCCACAGUUAA; | (SEQ ID NO: 597) |
| (iv) | ACUGAAUGACCUGCCAGUAUA; | (SEQ ID NO: 566) |
| (v) | UGUCCAUUUCAUCACAAAUCA; | (SEQ ID NO: 439) |
| (vi) | CCCACAGUUAAUGCACUUAGA; | (SEQ ID NO: 604) |
| (vii) | AGCUCUUUACCCACAGUUAAA; | (SEQ ID NO: 598) |
| (viii) | UUGUCUAUGGCUUAUUCUUGA; | (SEQ ID NO: 404) |
| (ix) | CCUUGAAUUCCCUCACGGAAA; | (SEQ ID NO: 464) |
| (x) | UCACAAAUCCCUUGUCAUACA; | (SEQ ID NO: 443) |
| (xi) and | AUGUUUGAAGCUGGGUAUUUA; | (SEQ ID NO: 493) |
| (xii) | GAAAACCUCCAACGUAUCAUA. | (SEQ ID NO: 473) |

11. The RNAi agent of any one of embodiments 1-10, wherein the RNAi agent comprises one or more modified nucleosides, optionally wherein each nucleoside of the antisense strand is a modified nucleoside and each nucleoside of the sense strand is a modified nucleoside.

12. The RNAi agent of embodiment 11, wherein the one or more modified nucleosides are 2' modified nucleosides.

13. The RNAi agent of embodiment 12, wherein the 2'-modified nucleoside is selected from 2'-fluoro (2'-F), 2'-O-methyl (2'-O-Me), 2'-O-methoxyethyl (2'-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O-NMA) modified nucleoside and combinations thereof, optionally wherein the 2'-modified nucleoside is selected from a 2'-O-methyl (2'-O-Me) modified nucleoside, a 2'-fluoro (2'-F) modified nucleoside, and combinations thereof.

14. The RNAi agent of any one of embodiments 11-13, wherein each nucleoside of the antisense strand is selected from a 2'-F modified nucleoside and a 2'-O-Me modified nucleoside, and each nucleoside of the sense strand is a 2'-modified nucleoside selected from a 2'-F modified nucleoside and a 2'-O-Me modified nucleoside.

15. The RNAi agent of any one of embodiments 11-14, wherein the nucleosides at one or more positions 9, 10, 11, and 12 (counting 5'→3') of the sense strand are 2'-F modified nucleosides, optionally wherein the nucleosides at positions 9, 10, 11, and 12 (counting 5'→3') of the sense strand are 2'-F modified nucleosides.

16. The RNAi agent of any one of embodiments 11-15, wherein the nucleosides at one or more positions 1, 2, 3, 4, 5, 6, 7, 8 and 13, 14, 15, 16, 17, 18, 19, 20, 21 (counting 5'→3') of the sense strand are 2'-O-Me modified nucleosides, optionally wherein the nucleosides at positions 1, 2, 3, 4, 5, 6, 7, 8 and 13, 14, 15, 16, 17, 18, 19, 20, 21 (counting 5'→3') of the sense strand are 2'-O-Me modified nucleosides.

17. The RNAi agent of any one of embodiments 11-16, wherein the nucleosides at one or more positions 2, 3, 5, 6, 7, 8, 10, and 14 (counting 5'→3') of the antisense strand are 2'-F modified nucleosides.

18. The RNAi agent of any one of embodiments 11-17, wherein the nucleosides at positions 2, 3, 5, 7, 8, 10, and 14 (counting 5'→3') of the antisense strand are 2'-F modified nucleosides.

19. The RNAi agent of any one of embodiments 11-17, wherein the nucleosides at positions 2, 3, 5, 6, 7, 10, and 14 (counting 5'→3') of the antisense strand are 2'-F modified nucleosides.

20. The RNAi agent of any one of embodiments 11-17, wherein the nucleosides at positions 2, 3, 5, 6, 7, 8, 10, and 14 (counting 5'→3') of the antisense strand are 2'-F modified nucleosides.

21. The RNAi agent of any one of embodiments 11-17, wherein the nucleosides at positions 2, 3, 7, 10, and 14 (counting 5'→3') of the antisense strand are 2'-F modified nucleosides.

22. The RNAi agent of any one of embodiments 11-21, wherein the nucleosides at one or more positions 1, 4, 5, 6, 8, 9, 11-13, and 15-23 (counting 5'→3') of the antisense strand are 2'-O-Me modified nucleosides, optionally wherein the nucleosides at positions 1, 4, 9, 11-13, and 15-23 (counting 5'→3') of the antisense strand are 2'-O-Me modified nucleosides.

23. The RNAi agent of any one of embodiments 1-22, wherein the RNAi agent comprises one or more modified internucleoside linkages, optionally wherein the RNAi agent comprises one or more phosphorothioate internucleoside linkages in at least one strand.

24. The RNAi agent of any one of embodiments 1-23, wherein the RNAi agent comprises two phosphorothioate internucleoside linkages in the sense strand, optionally wherein the two phosphorothioate internucleoside linkages are the first two internucleoside linkages in the sense strand from 5'→3'.

25. The RNAi agent of any one of embodiments 1-24, wherein the RNAi agent comprises four phosphorothioate internucleoside linkages in the antisense strand, wherein the four phosphorothioate internucleoside linkages are the first two internucleoside linkages and the last two internucleoside linkages in the antisense strand from 5'→3'.

26. The RNAi agent of any one of embodiments 1-25, wherein the RNAi agent comprises a sense strand and an antisense strand, wherein the nucleosides at positions 9, 10, 11, 12 (counting 5'→3') of the sense strand are 2'-F modified nucleosides, wherein the nucleosides at positions 2, 3, 5, 7, 8, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages.

27. The RNAi agent of any one of embodiments 1-25, wherein the RNAi agent comprises a sense strand and an antisense strand, wherein the nucleosides at positions 9, 10, 11, 12 (counting 5'→3') of the sense strand are 2'-F modified nucleosides, wherein the nucleosides at positions 2, 3, 5, 6, 7, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages.

28. The RNAi agent of any one of embodiments 1-25, wherein the RNAi agent comprises a sense strand and an antisense strand, wherein the nucleosides at positions 9, 10, 11, 12 (counting 5'→3') of the sense strand are 2'-F modified nucleosides, wherein the nucleosides at positions 2, 3, 5, 6, 7, 8, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages.

29. The RNAi agent of any one of embodiments 1-25, wherein the RNAi agent comprises a sense strand and an antisense strand, wherein the nucleosides at positions 9, 10, 11, 12 (counting 5'→3') of the sense strand are 2'-F modified nucleosides, wherein the nucleosides at positions 2, 3, 7, 10, and 14 (counting 5'→3') of the antisense strand are 2'-F modified nucleosides, wherein all nucleosides of the antisense strand and the sense strand that are not 2'-F modified nucleosides are 2'-O-Me modified nucleosides, and wherein the first two internucleoside linkages of the sense strand (from 5'→3') and the first two and the last two internucleoside linkages of the antisense strand (from 5'→3') are phosphorothioate internucleoside linkages.

30. The RNAi agent of embodiment 1 or embodiment 2, wherein the antisense strand and the sense strand comprise a structure as provided in Table 5B, Table 7B, or Table 9.

31. The RNAi agent of embodiment 1 or embodiment 2, wherein the antisense strand comprises the nucleobase sequence of SEQ ID NO: 1173 and a structure (5'→3') of

[mUs][fCs][fU][mA][fA][mG][fU][fG][mC][fA][mU][mU][mA][fA][mC][mU][mG][mU][mG][mG][mGs][mAs][mG] (SEQ ID NO: 2016), wherein:

mA, mC, mG, and mU are 2'-O-methyl adenosine, 2'-O-methyl cytidine, 2'-O-methyl guanosine, and 2'-O-methyl uridine, respectively;

fA, fC, fG, and fU are 2'-fluoro adenosine, 2'-fluoro cytidine, 2'-fluoro guanosine, and 2'-fluoro uridine, respectively; and s is a phosphorothioate linkage.

32. The RNAi agent of embodiment 31, wherein the sense strand comprises the nucleobase sequence of SEQ ID NO: 604 and a structure (5'→3') of

[mCs][mCs][mC][mA][mC][mA][mG][mU][fU][fA][fA][fU][mG][mC][mA][mC][mU][mU][mA][mG][mAs] (SEQ ID NO: 1425), wherein:

mA, mC, mG, and mU are 2'-O-methyl adenosine, 2'-O-methyl cytidine, 2'-O-methyl guanosine, and 2'-O-methyl uridine, respectively;

fA, fC, fG, and fU are 2'-fluoro adenosine, 2'-fluoro cytidine, 2'-fluoro guanosine, and 2'-fluoro uridine, respectively; and s is a phosphorothioate linkage.

33. The RNAi agent of embodiment 1 or embodiment 2, wherein the antisense strand comprises the nucleobase sequence of SEQ ID NO: 1174 and a structure (5'→3') of

[mUs][fUs][fU][mA][fA][mC][fU][fG][mU][fG][mG][mG][mU][fA][mA][mA][mG][mA][mG][mC][mUs][mAs][mG] (SEQ ID NO: 2020), wherein:

mA, mC, mG, and mU are 2'-O-methyl adenosine, 2'-O-methyl cytidine, 2'-O-methyl guanosine, and 2'-O-methyl uridine, respectively;

fA, fC, fG, and fU are 2'-fluoro adenosine, 2'-fluoro cytidine, 2'-fluoro guanosine, and 2'-fluoro uridine, respectively; and s is a phosphorothioate linkage.

34. The RNAi agent of embodiment 33, wherein the sense strand comprises the nucleobase sequence of SEQ ID NO: 598 and a structure (5'→3') of

[mAs][mGs][mC][mU][mC][mU][mU][mU][fA][fC][fC][fC][mA][mC][mA][mG][mU][mU][mA][mA][mAs] (SEQ ID NO: 1418), wherein:

mA, mC, mG, and mU are 2'-O-methyl adenosine, 2'-O-methyl cytidine, 2'-O-methyl guanosine, and 2'-O-methyl uridine, respectively;

fA, fC, fG, and fU are 2'-fluoro adenosine, 2'-fluoro cytidine, 2'-fluoro guanosine, and 2'-fluoro uridine, respectively; and s is a phosphorothioate linkage.

35.0. The RNAi agent of embodiment 1 or embodiment 2, wherein the antisense strand comprises the nucleobase sequence of SEQ ID NO: 1180 and a structure (5'→3') selected from the group consisting of (SEQ ID NO: 2055)
[mUs][fCs][mA][fA][mG][fA][mA][fU][mA][fA][mG][mC][mC][fA][mU][fA][mG][fA][mC][fA][mAs][mAs][mG], (SEQ ID NO: 2056)
[mUs][fCs][fA][fA][mG][fA][mA][fU][mA][fA][mG][fC][mC][fA][mU][fA][mG][fA][mC][fA][mAs][mAs][mG], (SEQ ID NO: 2057)
[mUs][fCs][mA][mA][mG][fA][mA][fU][fA][mA][mG][mC][mC][fA][mU][fA][mG][mA][mC][mA][mAs][mAs][mG], (SEQ ID NO: 2058)
[mUs][fCs][mA][mA][mG][fA][mA][mU][mA][mA][mG][mC][mC][fA][mU][fA][mG][mA][mC][mA][mAs][mAs][mG],
and (SEQ ID NO: 2059)
[mUs][fCs][mA][mA][mG][fA][gA][fU][fA][mA][mG][mC][mC][fA][mU][fA][mG][mA][mC][mA][mAs][mAs][mG], wherein:

mA, mC, mG, and mU are 2'-O-methyl adenosine, 2'-O-methyl cytidine, 2'-O-methyl guanosine, and 2'-O-methyl uridine, respectively;

fA, fC, fG, and fU are 2'-fluoro adenosine, 2'-fluoro cytidine, 2'-fluoro guanosine, and 2'-fluoro uridine, respectively;

gA is GNA adenosine; and s is a phosphorothioate linkage.

35. The RNAi agent of embodiment 1 or embodiment 2, wherein the antisense strand comprises the nucleobase sequence of SEQ ID NO: 1180 and a structure (5'→3') of

[mUs][fCs][fA][mA][fG][fA][fA][fU][mA][fA][mG][mC][mC][fA][mU][mA][mG][mA][mC][mA][mAs][mAs][mG] (SEQ ID NO: 2029), wherein:

mA, mC, mG, and mU are 2'-O-methyl adenosine, 2'-O-methyl cytidine, 2'-O-methyl guanosine, and 2'-O-methyl uridine, respectively;

fA, fC, fG, and fU are 2'-fluoro adenosine, 2'-fluoro cytidine, 2'-fluoro guanosine, and 2'-fluoro uridine, respectively; and s is a phosphorothioate linkage.

36.0. The RNAi agent of embodiment 35.0, wherein the sense strand comprises the nucleobase sequence of SEQ ID NO: 404 and a structure (5'→3') of (SEQ ID NO: 2060)
[fUs][mUs][fG][mU][fC][mU][fA][mU][fG][fG][fC][mU][fU][mA][fU][mU][fC][mU][fU][mG][fAs], (SEQ ID NO: 2062)
[mUs][mUs][mG][mU][mC][mU][fA][mU][fG][mG][fC][mU][fU][mA][fU][mU][mC][mU][mU][mG][mAs],
and (SEQ ID NO: 2061)
[mUs][mUs][mG][mU][mC][mU][fA][mU][fG][fG][fC][mU][mU][mA][mU][mU][mC][mU][mU][mG][mAs], wherein:

mA, mC, mG, and mU are 2'-O-methyl adenosine, cytidine, guanosine, and uridine, respectively;

fA, fC, fG, and fU are 2'-fluoro adenosine, cytidine, guanosine, and uridine, respectively; and s is a phosphorothioate linkage.

36. The RNAi agent of embodiment 35, wherein the sense strand comprises the nucleobase sequence of SEQ ID NO: 404 and a structure (5'→3') of

[mUs][mUs][mG][mU][mC][mU][mA][mU][fG][fG][fC][fU][mU][mA][mU][mU][mC][mU][mU][mG][mAs] (SEQ ID NO: 1202), wherein:

mA, mC, mG, and mU are 2'-O-methyl adenosine, 2'-O-methyl cytidine, 2'-O-methyl guanosine, and 2'-O-methyl uridine, respectively;

fA, fC, fG, and fU are 2'-fluoro adenosine, 2'-fluoro cytidine, 2'-fluoro guanosine, and 2'-fluoro uridine, respectively; and s is a phosphorothioate linkage.

37. The RNAi agent of embodiment 1 or embodiment 2, wherein the antisense strand comprises the nucleobase sequence of SEQ ID NO: 1181 and a structure (5'→3') of

[mUs][fUs][fU][mC][fC][fG][fU][mG][mA][fG][mG][mG][mA][fA][mU][mU][mC][mA][mA][mG][mGs][mAs][mG] (SEQ ID NO: 2033), wherein:

mA, mC, mG, and mU are 2'-O-methyl adenosine, 2'-O-methyl cytidine, 2'-O-methyl guanosine, and 2'-O-methyl uridine, respectively;

fA, fC, fG, and fU are 2'-fluoro adenosine, 2'-fluoro cytidine, 2'-fluoro guanosine, and 2'-fluoro uridine, respectively; and s is a phosphorothioate linkage.

38. The RNAi agent of embodiment 37, wherein the sense strand comprises the nucleobase sequence of SEQ ID NO: 464 and a structure (5'→3') of

[mCs][mCs][mU][mU][mG][mA][mA][mU][fU][fC][fC][fC][mU][mC][mA][mC][mG][mG][mA][mA][mAs] (SEQ ID NO: 1267), wherein:

mA, mC, mG, and mU are 2'-O-methyl adenosine, 2'-O-methyl cytidine, 2'-O-methyl guanosine, and 2'-O-methyl uridine, respectively;

fA, fC, fG, and fU are 2'-fluoro adenosine, 2'-fluoro cytidine, 2'-fluoro guanosine, and 2'-fluoro uridine, respectively; and s is a phosphorothioate linkage.

39. The RNAi agent of any one of embodiments 1-38, further comprising a targeting moiety.

40. The RNAi agent of embodiment 39, wherein the targeting moiety is conjugated to the 3' end of the sense strand of the RNAi agent.

41. The RNAi agent of embodiment 39 or embodiment 40, wherein the targeting moiety comprises N-acetyl-galactosamine (GalNAc), optionally wherein the targeting moiety comprises a GalNAc trimer.

42. The RNAi agent of any one of embodiments 39-41, wherein the targeting moiety comprises one or more instances of GalNAc attached through a monovalent, bivalent, trivalent, or tetravalent branched linker.

43. The RNAi agent of embodiment 39, wherein the targeting moiety is of formula:

($Z^6$)

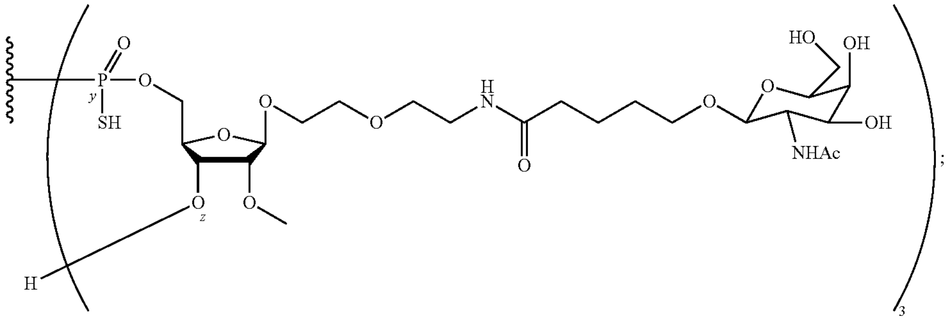

;

or a pharmaceutically acceptable salt thereof, wherein the

indicates the attachment point that is covalently linked to the 3'-O of the sugar moiety of the 3' terminal nucleoside of the sense strand.

43.1. The RNAi agent of embodiment 39, wherein the targeting moiety is of formula:

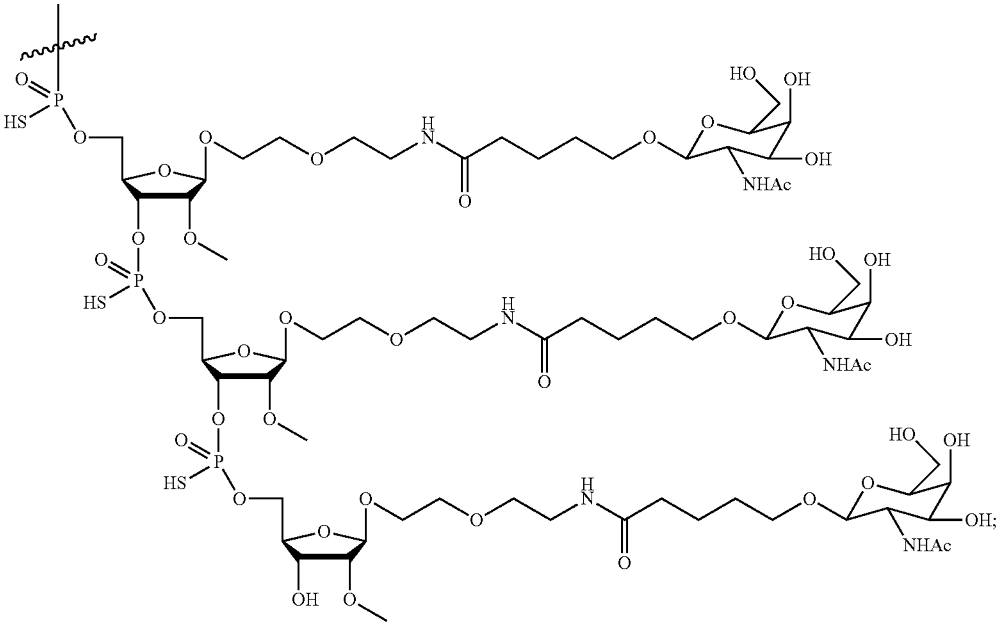

or a pharmaceutically acceptable salt thereof, wherein the

indicates the attachment point that is covalently linked to the 3'-O of the sugar moiety of the 3' terminal nucleoside of the sense strand.

44. The RNAi agent of embodiment 43 or 43.1, wherein the resulting conjugate comprises a structure of:

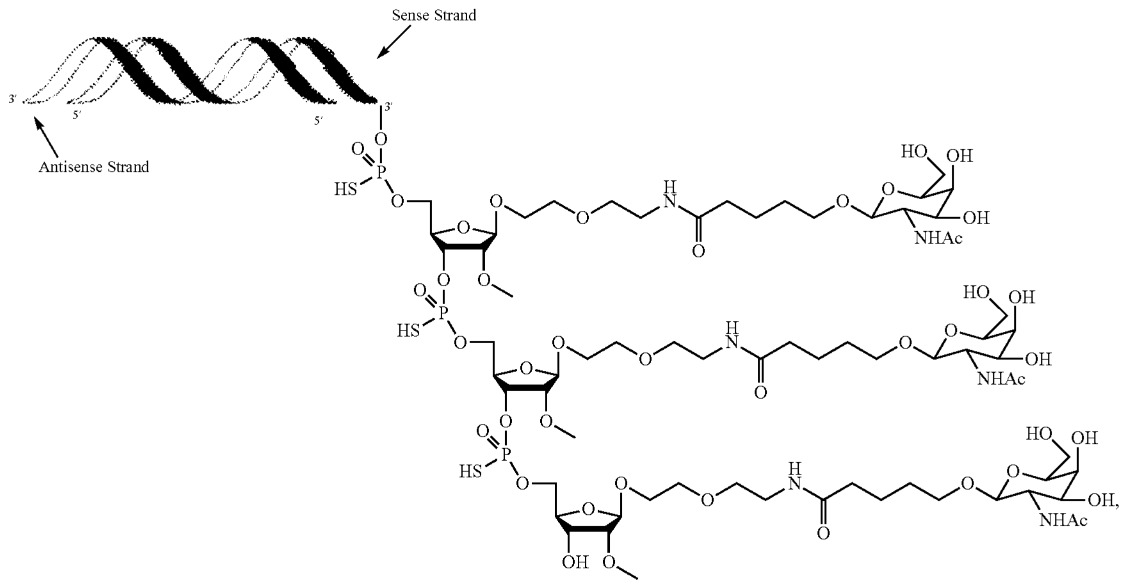

or a pharmaceutically acceptable salt thereof.

45. An RNAi agent comprisiing:

an antisense strand comprising the nucleobase sequence of SEQ ID NO: 1173 and a strucutre (5'→3') of

[mUs][fCs][fU][mA][fA][mG][fU][fG][mC][fA][mU][mU][mA][fA][mC][mU][mG][mU][mG][mG][mGs][mAs][mG] (SEQ ID NO: 2016), wherein:

an a sense strand comprising the nucleobase sequence of SEQ ID NO: 604 and a structure (5'→3') of (SEQ ID NO: 1425)
[mCs][mCs][mC][mA][mC][mA][mG][mU][fU][fA][fA][fU][mG][mC][mA][mC][mU][mU][mA][mG][mAs];

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage; and wherein the 3' terminal nucleoside of the sense strand is covalently linked to a structure of Formula ($Z^6$)

($Z^6$)

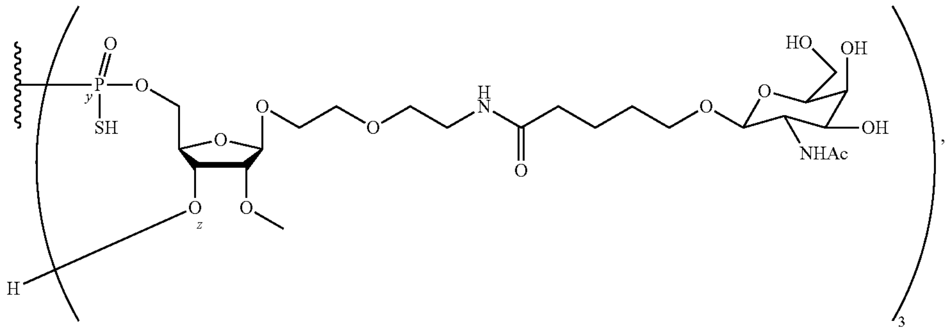, or a pharmaceutically acceptable salt thereof, wherein the "s" of the 3'-terminal [mAs] of the sense strand corresponds to the phosphorothioate linkage of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formula ($Z^6$).

46. An RNAi agent comprising:

an antisense strand comprising the nucleobase sequence of SEQ ID NO: 1174 and a structure (5'→3') of [mUs][fUs][fU][mA][fA][mC][fU][fG][mU][fG][mG][mG][mU][fA][mA][mA][mG][mA][mG][mC][mUs][mAs][mG] (SEQ ID NO: 2020); and a sense strand comprising the nucleobase sequence of SEQ ID NO: 598 and a structure (5'→3') of

```
                                    (SEQ ID NO: 1418)
[mAs][mGs][mC][mU][mC][mU][mU][mU][fA][fC][fC][fC]
[mA][mC][mA][mG][mU][mU][mA][mA][mAs];
```

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage; and wherein the 3' terminal nucleoside of the sense strand is covalently linked to a structure of Formula ($Z^6$)

($Z^6$)

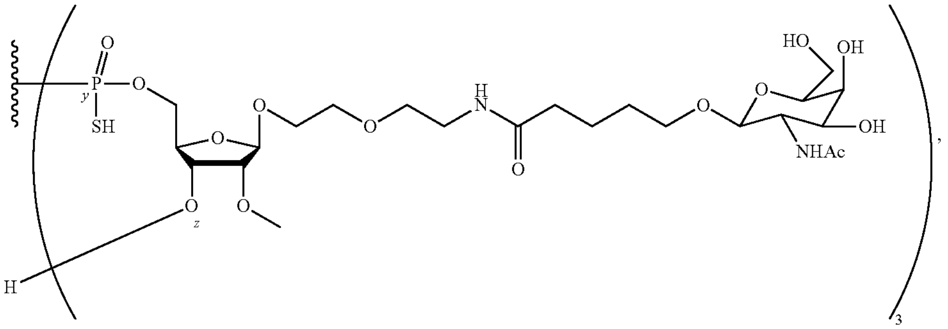

or a pharmaceutically acceptable salt thereof, wherein the "s" of the 3'-terminal [mAs] of the sense strand corresponds to the phosphorothioate linkage of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formula ($Z^6$).

47. An RNAi agent comprising:

an antisense strand comprising the nucleobase sequence of SEQ ID NO: 1180 and a structure (5'→3') of [mUs][fCs][fA][mA][fG][fA][fA][fU][mA][fA][mG][mC][mC][fA][mU][mA][mG][mA][mC][mA][mAs][mAs][mG] (SEQ ID NO: 2029); and a sense strand comprising the nucleobase sequence of SEQ ID NO: 404 and a structure (5'→3') of

```
                                    (SEQ ID NO: 1202)
[mUs][mUs][mG][mU][mC][mU][mA][mU][fG][fG][fC][fU]
[mU][mA][mU][mU][mC][mU][mU][mG][mAs];
```

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage; and wherein the 3' terminal nucleoside of the sense strand is covalently linked to a structure of Formula ($Z^6$)

(Z6)

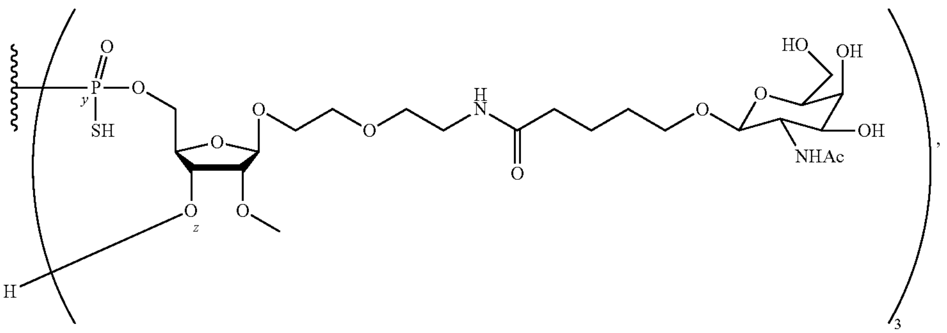

or a pharmaceutically acceptable salt thereof, wherein the "s" of the 3'-terminal [mAs] of the sense strand corresponds to the phosphorothioate linkage of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formula ($Z^6$).

47.1. An RNAi agent comprising:

an antisense strand comprising the nucleobase sequence of SEQ ID NO: 1180 and a structure (5'→3') of [mUs][fCs][mA][fA][mG][fA][mA][fU][mA][fA][mG][mC][mC][fA][mU][fA][mG][fA][mC][fA][mAs][mAs][mG] (SEQ ID NO: 2055); and a sense strand comprising the nucleobase sequence of SEQ ID NO: 404 and a structure (5'→3') of (SEQ ID NO: 2060)
[fUs][mUs][fG][mU][fC][mU][fA][mU][fG][fG][fC][mU][fU][mA][fU][mU][fC][mU][fU][mG][fAs];

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage; and wherein the 3' terminal nucleoside of the sense strand is covalently linked to a structure of Formula ($Z^6$)

(Z6)

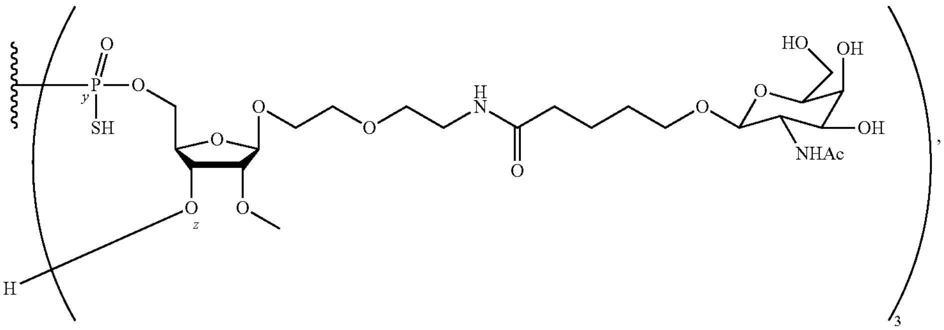

or a pharmaceutically acceptable salt thereof, wherein the "s" of the 3'-terminal [mAs] of the sense strand corresponds to the phosphorothioate linkage of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formula ($Z^6$).

47.2. An RNAi agent comprising:

an antisense strand comprising the nucleobase sequence of SEQ ID NO: 1180 and a structure (5'→>3') of [mUs][fCs][fA][fA][mG][fA][mA][fU][mA][fA][mG][fC][mC][fA][mU][fA][mG][fA][mC][fA][mAs][mAs][mG] (SEQ ID NO: 2056); and a sense strand comprising the nucleobase sequence of SEQ ID NO: 404 and a structure (5'→3') of (SEQ ID NO: 2062)
[mUs][mUs][mG][mU][mC][mU][fA][mU][fG][mG][fC][mU]
[fU][mA][fU][mU][mC][mU][mU][mG][mAs];

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage; and wherein the 3' terminal nucleoside of the sense strand is covalently linked to a structure of Formula ($Z^6$)

($Z^6$)

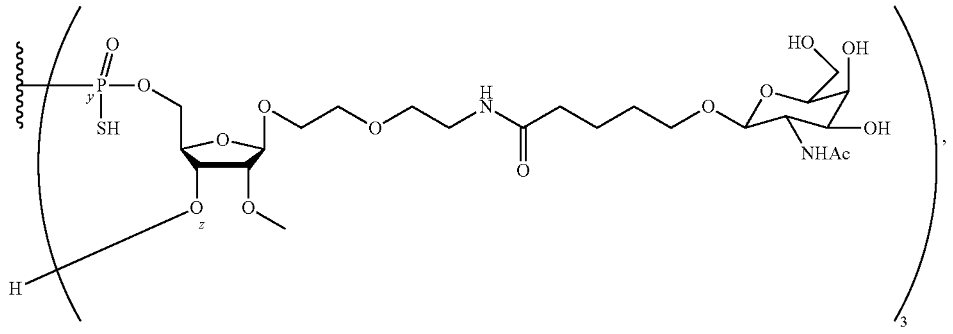

or a pharmaceutically accept-able salt thereof, wherein the "s" of the 3'-terminal [mAs] of the sense strand corresponds to the phosphorothioate linkage of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formula ($Z^6$).

47.3. An RNAi agent comprising:

an antisense strand comprising the nucleobase sequence of SEQ ID NO: 1180 and a structure (5'→3') of [mUs][fCs][mA][mA][mG][fA][mA][fU][fA][mA][mG][mC][mC][fA][mU][fA][mG][mA][mC][mA][mAs][mAs][mG] (SEQ ID NO: 2057); and a sense strand comprising the nucleobase sequence of SEQ ID NO: 404 and a structure (5'→3') of (SEQ ID NO: 2061)
[mUs][mUs][mG][mU][mC][mU][fA][mU][fG][fG][fC][mU]
[mU][mA][mU][mU][mC][mU][mU][mG][mAs];

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage; and wherein the 3' terminal nucleoside of the sense strand is covalently linked to a structure of Formula ($Z^6$)

($Z^6$)

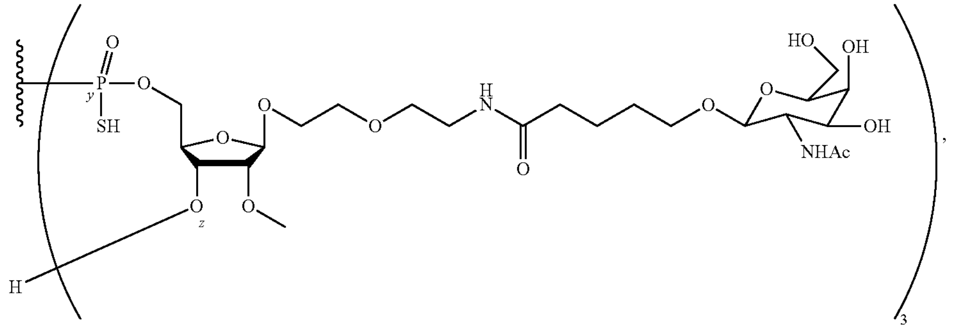

or a pharmaceutically acceptable salt thereof, wherein the "s" of the 3'-terminal [mAs] of the sense strand corresponds to the phosphorothioate linkage of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formula ($Z^6$).

47.4. An RNAi agent comprising:

an antisense strand comprising the nucleobase sequence of SEQ ID NO: 1180 and a structure (5'→3') of [mUs][fCs][mA][mA][mG][fA][mA][mU][mA][mA][mG][mC][mC][fA][mU][fA][mG][mA][mC][mA][mAs][mAs][mG] (SEQ ID NO: 2058); and a sense strand comprising the nucleobase sequence of SEQ ID NO: 404 and a structure (5'→3') of (SEQ ID NO: 2061)
[mUs][mUs][mG][mU][mC][mU][fA][mU][fG][fG][fC][mU][mU][mA][mU][mU][mC][mU][mU][mG][mAs];

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage; and wherein the 3' terminal nucleoside of the sense strand is covalently linked to a structure of Formula ($Z^6$)

or a pharmaceutically acceptable salt thereof, wherein the "s" of the 3'-terminal [mAs] of the sense strand corresponds to the phosphorothioate linkage of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formula ($Z^6$).

47.5. An RNAi agent comprising:

an antisense strand comprising the nucleobase sequence of SEQ ID NO: 1180 and a structure (5'→3') of [mUs][fCs][mA][mA][mG][fA][gA][fU][fA][mA][mG][mC][mC][fA][mU][fA][mG][mA][mC][mA][mAs][mAs][mG] (SEQ ID NO: 2059); and a sense strand comprising the nucleobase sequence of SEQ ID NO: 404 and a structure (5'→3') of (SEQ ID NO: 2061)
[mUs][mUs][mG][mU][mC][mU][fA][mU][fG][fG][fC][mU][mU][mA][mU][mU][mC][mU][mU][mG][mAs];

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; gA is GNA adenosine; and s is a phosphorothioate linkage;

and wherein the 3' terminal nucleoside of the sense strand is covalently linked to a structure of Formula ($Z^6$)

($Z^6$)

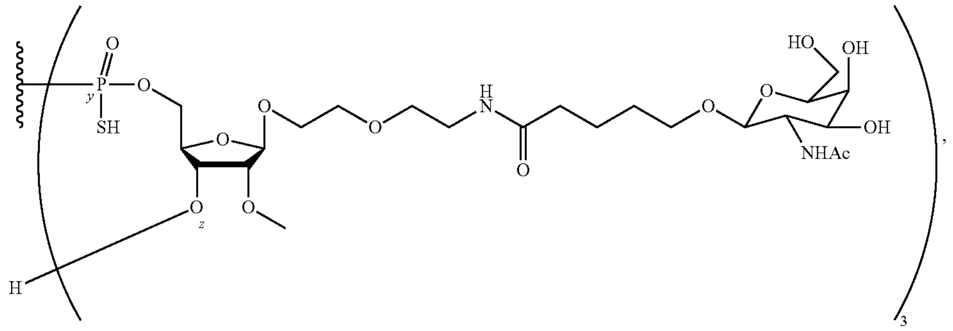

(Z$^6$)

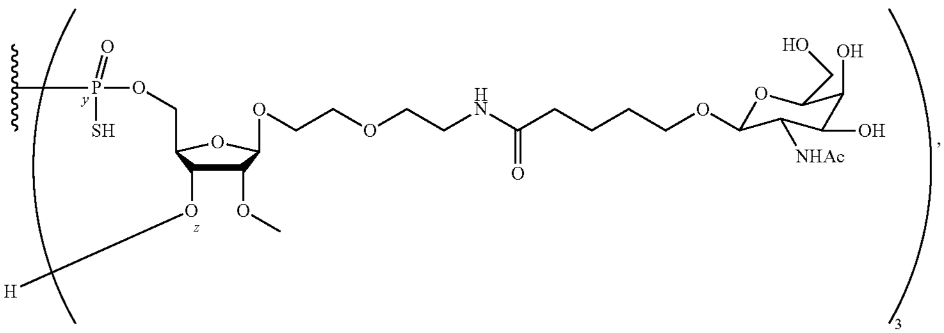

, or a pharmaceutically acceptable salt thereof, wherein the "s" of the 3'-terminal [mAs] of the sense strand corresponds to the phosphorothioate linkage of the first repeat unit of a targeting moiety (i.e., the repeat unit that is directly covalently linked to the 3'-O of the sugar moiety of the 3' terminal nucleoside of the sense strand), wherein the targeting moiety comprises a structure of Formula (Z$^6$).

48. An RNAi agent comprising:

an antisense strand comprising the nucleobase sequence of SEQ ID NO: 1181 and a structure (5'→3') of

[mUs][fUs][fU][mC][fC][fG][fU][mG][mA][fG][mG][mG][mA][fA][mU][mU][mC][mA][mA][mG][mGs][mAs][mG] (SEQ ID NO: 2033); and a sense strand comprising the nucleobase sequence of SEQ ID NO: 464 and a structure (5'→3') of (SEQ ID NO: 1267)

[mCs][mCs][mU][mU][mG][mA][mA][mU][fU][fC][fC][fC][mU][mC][mA][mC][mG][mG][mA][mA][mAs];

wherein mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage; and wherein the 3' terminal nucleoside of the sense strand is covalently linked to a structure of Formula (Z$^6$)

lently linked to the 3'-O of the sugar moiety of the 3' terminal nucleoside of the sense strand), wherein the targeting moiety comprises a structure of Formula (Z$^6$).

49. A conjugate comprising a Cytochrome P450 family 7 subfamily A member 1 (CYP7A1) RNAi agent covalently linked to a targeting moiety, wherein the CYP7A1 RNAi agent comprises a sense strand and an antisense strand, wherein the antisense strand comprises the nucleobase sequence of SEQ ID NO: 1180 and a structure (5'→3') of

[mUs][fCs][fA][mA][fG][fA][fA][fU][mA][fA][mG][mC][mC][fA][mU][mA][mG][mA][mC][mA][mAs][mAs][mG] (SEQ ID NO: 2029); and wherein the sense strand comprises the nucleobase sequence of SEQ ID NO: 404 and a structure (5'→3') of

[mUs][mUs][mG][mU][mC][mU][mA][mU][fG][fG][fC][fU][mU][mA][mU][mU][mC][mU][mU][mG][mAs] (SEQ ID NO: 1202); wherein:

mA, mC, mG, and mU are 2'-O-methyl adenosine, cytidine, guanosine, and uridine, respectively; fA, fC, fG, and fU are 2'-fluoro adenosine, cytidine, guanosine, and uridine, respectively; and s is a phosphorothioate linkage;

wherein the targeting moiety is covalently linked to the 3' terminal nucleoside of the sense strand and the s of (Z$^6$)

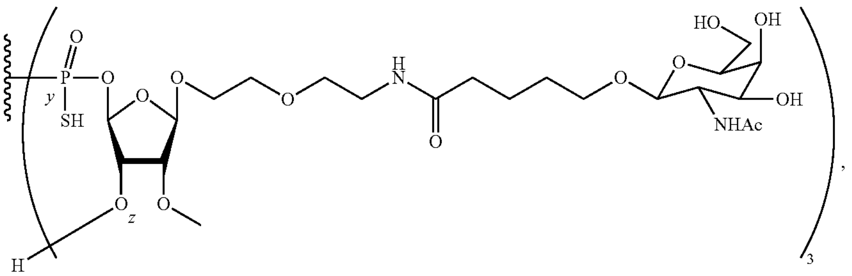

, or a pharmaceutically acceptable salt thereof, wherein the "s" of the 3'-terminal [mAs] of the sense strand corresponds to the phosphorothioate linkage of the first repeat unit of a targeting moiety (i.e., the repeat unit that is directly covathe 3'-terminal [mAs] of the sense strand corresponds to the phosphorothioate linkage of a first repeat unit of the targeting moiety, wherein the conjugate comprises a structure of:

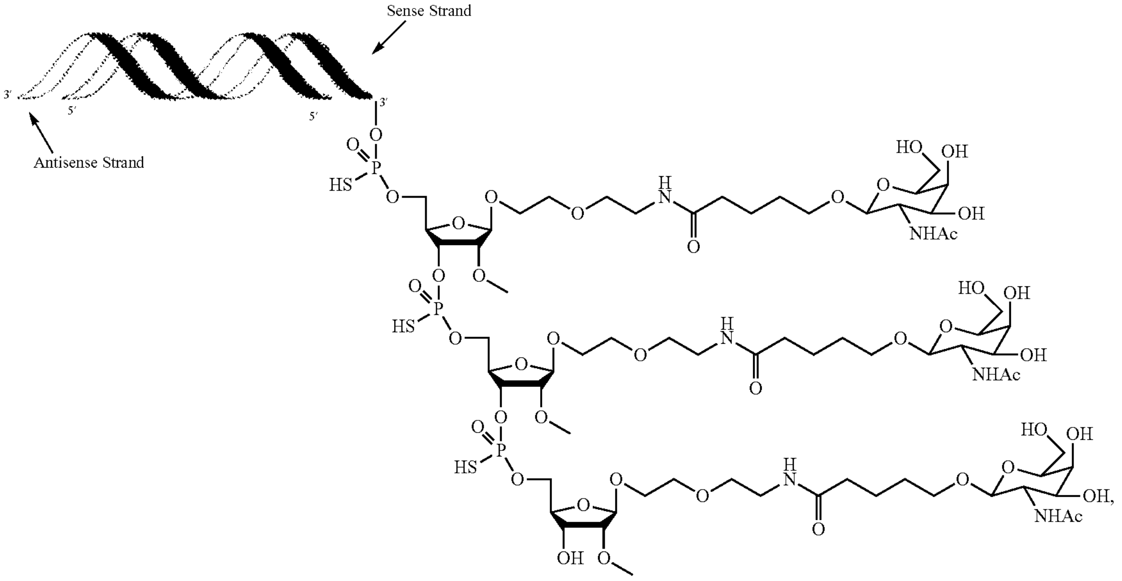

or a pharmaceutically acceptable salt thereof.

50. A pharmaceutical composition for inhibiting expression of a gene encoding CYP7A1 comprising the RNAi agent of any one of embodiments 1-48 or the conjugate of embodiment 49.

51. A method of inhibiting expression of a CYP7A1 gene in a cell, the method comprising contacting the cell with the RNAi agent of any one of embodiments 1-48, the conjugate of embodiment 49, or the pharmaceutical composition of embodiment 50, thereby inhibiting expression of the CYP7A1 gene in the cell.

52. The method of embodiment 51, wherein the cell is within a subject, optionally wherein the subject is human.

53. The method of embodiment 52, wherein the subject has a CYP7A1 disease or CYP7A1-associated disease.

54. A method of treating a subject having a CYP7A1 disease or CYP7A1-associated disease, comprising administering to the subject a therapeutically effective amount of the RNAi agent of any one of embodiments 1-48, the conjugate of embodiment 49, or the pharmaceutical composition of embodiment 50, thereby treating the subject having the CYP7A1 disease or CYP7A1-associated disease.

55. A method of treating at least one symptom in a subject having a CYP7A1 disease or CYP7A1-associated disease, comprising administering to the subject an effective amount of the RNAi agent of any one of embodiments 1-48, the conjugate of embodiment 49, or the pharmaceutical composition of embodiment 50, thereby treating at least one symptom in the subject having the CYP7A1 disease or CYP7A1-associated disease.

56. The method of embodiment 54 or embodiment 55, wherein the disease is a CYP7A1 disease or CYP7A1-associated disease, optionally wherein the CYP7A1 disease or CYP7A1-associated disease is primary sclerosing cholangitis (PSC).

57. The method of any one of embodiments 54-56, wherein the subject is human.

58. The method of any one of embodiments 54-57, further comprising administering an agent for the treatment of a CYP7A1 disease or CYP7A1-associated disease.

EQUIVALENTS

The disclosure may be embodied in other specific forms without departing from the spirit or essential characteristics thereof. The foregoing embodiments are therefore to be considered in all respects illustrative rather than limiting of the disclosure. Scope of the disclosure is thus indicated by the appended claims rather than by the foregoing description, and all changes that come within the meaning and range of equivalency of the claims are therefore intended to be embraced herein.

SEQUENCE LISTING (2062 sequences)

SEQ ID NO: 1 - DNA, 2877 bp, Homo sapiens
  source 1..2877: mol_type = other DNA
agtggcatccttccctttctaatcagagattttcttcctcagagattttggcctagatttgcaaaatgatgaccacatctttgatttgggggattgctatagcagcatgctgttgtctatggcttattcttggaattaggagaaggcaaacgggtgaaccacctctagagaatggattaattccatacctgggctgtgctctgcaatttggtgccaatcctcttgagttcctcagagcaaatcaaaggaaacatggtcatgtttttacctgcaaactaatgggaaaatatgtccatttcatcacaaatcccttgtcataccataaggtgttgtgccacggaaaatattttgattggaaaaaatttcactttgctacttctgcgaaggcatttgggcacagaagcattgacccgatggatggaaataccactgaaaacataaacgacactttcatcaaaaccctgcagggccatgccttgaattccctcacggaaagcatgatggaaaacctccaacgtatcatgagacctccagtctcctctaactcaaagaccgctgcctgggtgacagaagggatgtattctttctgctaccgagtgatgtttgaagctgggtatttaactatctttggcagagatcttacaaggcgggacacacagaaagcacatattctaaacaatcttgacaacttcaagcaattcgacaaagtctttccagccctggtagcaggcctccccattcacatgttcaggactgcgcacaatgcccgggagaaactggcagagagcttgaggcacgagaacctccaaaagagggaaagcatctcagaactgatcagcctgcgcatgtttctcaatgacactttgtccacctttgatgatctggagaaggccaagacacacctcgtggtcctctgggcatcgcaagcaaacaccattccagcgactttctggagtttatttcaaatgattaggaacccagaagcaatgaaagcagctactgaagaagtgaaaagaacattagagaatgctggtcaaaaagtcagcttggaaggcaatcctatttgtttgagtcaagcagaactgaatgacctgccagtattagatagtataatcaaggaatcgctgaggctttccagtgcctccctcaacatccggacagctaaggaggatttcactttgcaccttgaggacggttcctacaacatccgaaaagatgacatcatagctctttacccacagttaatgcacttagatccagaaatctacccagaccctttgacttttaaatatgataggtatcttgatgaaaacgggaagacaaagactaccttctattgtaatggactcaagttaaagtattactacatgccctttggatcgggagctacaatatgtcctggaagattgttcgctatccacgaaatcaagcaatttttgattctgatgctttcttattttgaattggagcttatagagggccaagctaaatgtccacctttggaccagtcccgggcaggcttgggcattttgccgccattgaatgatattgaatttaaatataaattcaagcatttgtgaatacatggctggaataagaggacactagatgatattacaggactgcagaacaccctcaccacacagtccctttggacaaatgcatttagtggtggtagaaatgattcaccaggtccaatgttgttcaccagtgcttgcttgtgaatcttaacattttggtgacagtttccagatgctatcacagactctgctagtgaaaagaactagtttctaggagcacaataatttgttttcatttgtataagtccatgaatgttcatatagccagggattgaagtttattattttcaaaggaaaacacctttattttattttttttcaaaatgaagatacacattacagccaggtgtggtagcaggcacctgtagtcttagctactcgagaggccaaagaaggaggatggcttgagcccaggagttcaagaccagcctggacagcttagtgagatcccgtctccgaagaaaagatatgtattctaattggcagattgttttttcctaaggaaactgctttatttttataaaactgcctgacaattatgaaaaaatgttcaaattcacgttctagtgaaactgcattatttgttgactagatggtggggttcttcgggtgtgatcatatatcataaaggatatttcaaatgattatgattagttatgtcttttaataaaaaggaaatatttttcaacttcttctatatccaaaattcagggctttaaacatgattatcttgatttcccaaaaacactaaaggtggttttattttcccttcatgttttaacttattgttgctgaaaactctatgtccggctttaactatcttctctatatttttatttcattcacattaatgagaagagttttctcagagattaaaaaaggtagtttttctgtcattgttaaatacacattatcactgaaaaaatgtagcttttatgtgatatgttttaaagttaaaactggatggaaatagccatttggaagctttggttatgaaacatgtggagtgtattaagtgcagcttgacattatgttttatttaaatgctttttatcgctaaatgacttgcagatgaaaaaaactaaggtgactcgagtgtttaaatgctgtgtacaacaatgctttgataaaatattttaagtatgagttatcagctctatgtcaattgatatttctgtgtagtatttatatttaaattatatttacctttttgcttattttacaaatattaagaaaatattctaacatttgataattttgaaatgattcatctttcagaaataaaagtatgaatcta

SEQ ID NO: 2 - protein, 504 aa, Homo sapiens
MMTTSLIWGIAIAACCCLWLILGIRRRQTGEPPLENGLIPYLGCALQFGANPLEFLRANQRKHGHVFTCKLMGKYVHFITNPLSYHKVLCHGKYFDWKKFHFATSAKAFGHRSIDPMDGNTTENINDTFIKTLQGHALNSLTESMMENLQRIMRPPVSSNSKTAAWVTEGMYSFCYRVMFEAGYLTIFGRDLTRRDTQKAHILNNLDNFKQFDKVFPALVAGLPIHMFRTAHNAREKLAESLRHENLQKRESISELISLRMFLNDTLSTFDDLEKAKTHLVVLWASQANTIPATFWSLFQMIRNPEAMKAATEEVKRTLENAGQKVSLEGNPICLSQAELNDLPVLDSIIKESLRLSSASLNIRTAKEDFTLHLEDGSYNIRKDDIIALYPQLMHLDPEIYPDPLTFKYDRYLDENGKTKTTFYCNGLKLKYYYMPFGSGATICPGRLFAIHEIKQFLILMLSYFELELIEGQAKCPPLDQSRAGLGILPPLNDIEFKYKFKHL

SEQ ID NO: 3 - DNA, 4173 bp, Mus musculus
  source 1..4173: mol_type = other DNA
ggaccgtcttgctttgctaagcacagattctccccttgggacgttttcctgcttttgcaaaatgatgagcatttctttgatctgggggattgctgtggtagtgagctgttgcatatggtttatcattggaataaggagaaggaaagtaggtgaacctcctttggacaacgggttgattccatacctgggctgtgctctgaagttcggatccaatcctcttgaattcctaagagcaaagcaaaggaaacatggccatgtttttacctgcaaactgatggggaaatatgtccacttcatcacaaactccctgtcataccacaaagtcttatgtcacggaaaatattttgactggaaaaaatttcattacactacttctgcgaaggcatttggacacagaagcatagacccaagtgatggaaataccacggaaaacataaacaagacttttaacaaaaccctccagggagatgctctgtgttcactctctgaagccatgatgcaaaacctccaatctgtcatgagacctccgggccttcctaaatcaaagagcgctgtctgggtcacggaagggatgtatgccttctgctaccgagtgatgtttgaagccggatatctaacgctgtttggcaaagatatttcaaagacagactcacaaagagcatttattcaaaacaaccttgacagcttcaaacaatttgaccaagtatttccggcactagtggcgggcgtccctattcacttgttcaagaccgcacataaagcccgggaaaggctggctgagagcttgaagcacaagaacctgtacatgagggaccaggtctctgaactgatccgtctacgcatgtttctcaacgatacactctccacctttgatgacatggagaaggctaagacgcacctcgtgatcctctgggcatctcaagcaaacaccattcctgcaaccttctggagcttatttcaaatgatcaggagccctgaagcaatgaaagcagcctctgaagaagtgaatggagcattacagagtgctggccaagagctcagctctggagggaatgccatttacttggatcaagagcaactaaacaacctgccagtactagatagcatcatcaaggaggctctgcggctctccagtgcatccttgaatatccggacagctaaggaggacttcactctacaccttgaggatggttcctataacattcgaaaagatgacatcatagctctttacccacagttaatgcacttggatcctgaaatctacccagaccctttgacttttaaatacgaccggtaccttgatgaaagtgggaaagcaaagaccaccttctatagaaatggaaacaagctgaagtatttctacatgccctttggatcaggagctacaatatgtcctggaagactatttgctgtccaagaaatcaagcaatttttgattctgatgctgtcttactttgaactggagcttgtagagagccacaccaagtgtccccctctagatcagtcccgggcaggcttgggaattttgccaccactaaatgatattgagtttaaatataaactgaaacactgatatgtggttggaagaagaggacactggatgatgtaacgactgctgagcgttatcagtaaacaggcctttgggactagtgctcactgaagccccctagtagctgtattagtgagaagaactctgttcttactgctcacgttcctggggattcgtgtagctggggcctgagtttcatcactttcagagcaacgtcttttgtttttattttcaaaatgaagatattccaattggcagggttctttcctaaggaaattgctttatatttttatgaaaactaccgattaattatggaagtacttcaaattcacgttttagtgaaattattaatttttcactagtaaggttcttcatgtgtgagtatattataaaaatgttttagctgatcatatcatgctttgcataaagggaaaggaaattattgttcagctttttttttatggtggtgagagcttgaaaatgatcttactattctagaactactagggaagtttcgacatgctctcgctatattttaatttattgttgctggagatttttattccagttttgaactactttatctttccttctttttgacacacataccaataagaagagcatttttcagaaattataaaggcacctccaagaaccacaccatgagtcttttaagcctttaattccagctcccatgaggcaaagccaggcaaatctctatgagtctgaggttattctggtctacatcagctctagacaagccaggactacagaaaggaccttgtctaaaaagaaaaaaagttaatttctatgtcatatttgattatgaatcaacatgaaatataaatttaaaatcaggactcagagaaatgatcaattaaaaaacttagctatgaagtatgtggagttctttaagtacaagttgacattatatgttctttttttatggtttgttgtagaaaggcacggagaaagaaagaaggtagaaagagagagacaccggccatggccacgtggagagaggggggaagggaaagagagaaggaggcctagagagtaagaaaggtgagggcttaaagagctatatgctctttaaaaatgttttatgtttttatctctaaatgccttaaagatgaagaacaataatgaaaggctgagtaatagtgtttaaatactgagtgcaatagtgctttagtaatatactttaaagagagttattagctatgtcatttttactgaaaatatatttatatataaattatatttatctttttcttataccatatatataaaaatattgtaacatttagtaattttaaaattacacacctttcagaaattaacatatgaatgttcgtgttttaaactttgaacagaacatttaaattattcatctactggtaagctacaataatttttctcatatttatttaaaatattcatattttcaagaaatccaaaaatatccaaagtaatcactcagtcaaatagatccctaagatgacagtaaattcaataccatgcttttgtctgcgagggctggagcagggtccagtggatgctgtgcaggtcctccagcagagagctaaatccacagactcctcaaaatcttaaaaccttaccactgaatactggcacagagttattacctaggtacgctatgcttccttcctttttcattttgacagaggcccatagcatcccaggctggaacattccgcgtagcttaagcaagcttggaactcactgtgcttcctgctttgccttgttataggaagtaattttcaagaccaagaaaacttaattgtttagatgagctataagaaagacacaattgtgttgtatactaatctgtactaagctaaatttgtttttaaaacaagttttatgactccctgaactgaatgtatccacataccttcccatggctttttaaaagcatatttttcatacagaatgatgggtctcctggtggtgccttcttctcatatttttattcttgtgaagtgatggctagcaaacaatagcctgtcaaccaaagttactcttcccgtttctgtgcagcctaagtgttaaaagtaatttttacatttttaaatgcttaggggaaaaaaaccacatgtctattttgtgtcatatacgaagtatatgaaatacagactagcaaacccgtgactaaaacttttattgggatatcagaatctgcctaattctttgcgttatgtctacaattccattttttgacatgtgtatgtagtgtgcatttttgtggaagcatgtgtgagtgtgtgtgcacatgtgggtaaacatgtgtgcatgtgtgtagaggctggaggtgatgttgagtgttttcctccactgttctcccttgagggtctctcccttgagccagagtccaatgcttaggctagcatagccaacttgccgcagtgcccttgaattgcaggaggttgccacatcctcctggcatttaccctggtgtgagatgagcttcagaagggcaagtgctttgtctgctagtctcagtgtctacagctcttgctgtgtaattgtaaaggcagggtagtgtgacatagacaggaggacacagagcttaccatttcaaaaatcagtttcttcagagt

SEQ ID NO: 4 - protein, 503 aa, Mus musculus
MMSISLIWGIAVVVSCCIWFIIGIRRRKVGEPPLDNGLIPYLGCALKFGSNPLEFLRAKQRKHGHVFTCKLMGKYVHFITNSLSYHKVLCHGKYFDWKKFHYTTSAKAFGHRSIDPSDGNTTENINKTFNKTLQGDALCSLSEAMMQNLQSVMRPPGLPKSKSAVWVTEGMYAFCYRVMFEAGYLTLFGKDISKTDSQRAFIQNNLDSFKQFDQVFPALVAGVPIHLFKTAHKARERLAESLKHKNLYMRDQVSELIRLRMFLNDTLSTFDDMEKAKTHLVILWASQANTIPATFWSLFQMIRSPEAMKAASEEVNGALQSAGQELSSGGNAIYLDQEQLNNLPVLDSIIKEALRLSSASLNIRTAKEDFTLHLEDGSYNIRKDDIIALYPQLMHLDPEIYPDPLTFKYDRYLDESGKAKTTFYRNGNKLKYFYMPFGSGATICPGRLFAVQEIKQFLILMLSYFELELVESHTKCPPLDQSRAGLGILPPLNDIEFKYKLKH

SEQ ID NO: 5 - DNA, 3544 bp, Rattus norvegicus
  source 1..3544: mol_type = other DNA
gtctcccctttggaaattttcctgcttttgcaaaatgatgactatttctttgatttggggaattgccgtgttggtgagctgttgcatatggtttattgttggaataaggagaaggaaagctggtgaacctcctttggagaacgggttgattccgtacctgggctgtgctctgaaatttggatctaatcctcttgagttcctaagagctaatcaaaggaagcatggtcacgtttttacctgcaaactgatggggaaatatgtccatttcatcacaaactccctgtcataccacaaagtcttatgtcatggaaaatattttgactggaaaaaatttcattacactacttctgcgaaggcatttggacacagaagcattgacccaaatgatggaaataccacggaaaatataaacaacacttttaccaaaaccctccagggagatgctctgtgttcactttctgaagccatgatgcaaaacctccaatctgtcatgagacctcctggccttcctaaatcaaagagcaatgcctgggtcacggaagggatgtatgccttctgttaccgagtgatgtttgaagctggctatctaacactgtttggcagagatatttcaaagacagacacacaaaaagcacttattctaaacaaccttgacaacttcaaacaatttgaccaagtctttccggcactggtggcaggccttcctattcacttgttcaagaccgcacataaagctcgggaaaagctggctgagggattgaagcacaagaacctgtgtgtgagggaccaggtctctgaactgatccgtctacgtatgtttctcaatgacacgctctccacctttgacgacatggagaaggccaagacgcacctcgctattctctgggcatctcaagcaaacaccattcctgcaaccttttggagcttatttcaaatgatcaggagtcctgaagcaatgaaagcagcctctgaagaagtgagtggagctttacagagtgctggccaagagctcagctctggagggagtgccatttacttggatcaagtgcaactgaatgacctgccggtactagacagcatcatcaaggaggctctgaggctttccagtgcatccttgaatatccgcacagctaaggaggacttcactctccatcttgaggacggttcctataacatccgaaaagatgacatgatagctctttatccacagttaatgcacttggatcctgaaatctacccagaccctttgactttcaaatatgaccggtaccttgatgaaagcgggaaagcaaagaccaccttctacagtaatggaaacaagctgaagtgtttctacatgcccttcggatcaggcgcgacaatatgtcctggaagactctttgccgtccaagaaatcaagcagtttttgatcctgatgctctcctgctttgaactggagtttgtggagagccaagtcaagtgtccccctctagaccagtcccgggcaggcttgggaattttgccaccactacatgatattgagtttaaatataaactgaaacactgatacgtggttggaagaagcgaacactggatgatgtcacttggcggctgagagtcatcactaaacaggccttcgggaccaatgctcactgatgcgccctagcgactggattagtgggaagaactttgttctcgctgcccacattcctgggtgttcacatagctggggccagagcttcatcactttcagaaagcaatgtcttttgtatttattttcaaaatgaagatattccaattggcaggatatttttcctaaggaaattgctttatatttttatgaaaactaccaattaattatgaaagggcttgaaattcacgttttagtgaaattactgatttttcactagtaaggttcttcaggtgtgaaactgtattataaaaatgttgtaatgggtcacactgtgctttgcataaaggtaaaggaaactatgtttcagccttttctgtgtctatgagcttcgaaaataatcttactgttctagaaacactggggaggtttcgacatgctctcgctatattttattttactgttgctagaaattttcattccagttttcaactaccttatctttcccccattttgacatgcatgccaatgagaagagtattttttaggaattaacaaggcacctcccagaaccctaccctgagacttttaagcctttaatcccagcactcgagaagtagagccaggcagatctctgagtctgaggttattctggtctacatcagctccagacaagccaggactacagaatgggatcttgtctaaaaaatacagctaatctttatgtcataactgattatgaatcaacctaaaagataaattttcaatcaggactcagagaaaatgagcaattaaaaaacttagctctgaggtatgtggaattcattaagtacaagttgacattacatgttctttaaaaatagtttatgttttatctctaaatgccctgcagatgaagaataataatgaaaagttgaataatactgtttaaacactaagtgcaataatgctttggtaatgtactttaagagaatcattagccgtgccagttttactaaaatatatttatatgtaaattatatttatctttttcttataccataaatataaaaatattgcaacatttagtaattttaaaattatatacctttcagaaaatgatgtatgaatgtttgtatgttttttaactttgaacagaacatttaaattattcatctacggtgatttttatcttatttatttctttttgtctcattcatatcttgaagaaatccaaaaatatctgaaggaatcgctcactcaaatgtctccctatggttacagaaaaattcaataccatgtttttgtcctcggggactgaagcagggtgtcgtgggtgccgagcagaggctcctgctgcagcgagctttatccacgggactccttaaacttttaaaatcttatcactattatcatgcatttattacctaagtaggatatttccctttcctttttcatttcagccgagtcccttagcaacccaggctgactgggaccctccatgtagcttaagctgtgaactcactgtacttcctgttttcacttattttaggaagtaattttccctatcagaaattttaattgtttagatgatgtataagagtaacacaattctgttatatactaatctgtagtaaactaaatttgttcttagaacaagtttgatgactctcaaattgaatgtatccatacatctttccatggcttcttgaatgcccatttctcatacacagaatgatgggtttcacggtgatgtcttcctttcatgtctttattcttgtgcggtgatggttggcaaatgatacccatggagcaaggttactcttcctatttctgtgcagcctaagtgttaagaataatttttaaatacttggagggaaggcacattttgtgtcatatgtgaagtgacatgtgacacacagactagcaaatccttgagtaaaattttattgggat

SEQ ID NO: 6 - protein, 503 aa, Rattus norvegicus
MMTISLIWGIAVLVSCCIWFIVGIRRRKAGEPPLENGLIPYLGCALKFGSNPLEFLRANQRKHGHVFTCKLMGKYVHFITNSLSYHKVLCHGKYFDWKKFHYTTSAKAFGHRSIDPNDGNTTENINNTFTKTLQGDALCSLSEAMMQNLQSVMRPPGLPKSKSNAWVTEGMYAFCYRVMFEAGYLTLFGRDISKTDTQKALILNNLDNFKQFDQVFPALVAGLPIHLFKTAHKAREKLAEGLKHKNLCVRDQVSELIRLRMFLNDTLSTFDDMEKAKTHLAILWASQANTIPATFWSLFQMIRSPEAMKAASEEVSGALQSAGQELSSGGSAIYLDQVQLNDLPVLDSIIKEALRLSSASLNIRTAKEDFTLHLEDGSYNIRKDDMIALYPQLMHLDPEIYPDPLTFKYDRYLDESGKAKTTFYSNGNKLKCFYMPFGSGATICPGRLFAVQEIKQFLILMLSCFELEFVESQVKCPPLDQSRAGLGILPPLHDIEFKYKLKH

SEQ ID NO: 7 - DNA, 2953 bp, Macaca fascicularis
  source 1..2953: mol_type = other DNA
gtcaacaagctcaagttaatggatctgggtactatgtatataaaaaaacctagcttgagtctcttttcagtgacatctttgcctttctaatcagagattttcttcctcagagattttggcctagatttgcaaaatgatgaccatatctttgatttgggggattgctatagcagcatgctgttgtctatggcttattcttggaataaggagaaggcaaacgggtgaaccacctctagagaatgggttgattccatacctgggctgtgcgctgcaatttggtgccaatcctcttgagttcctcagagcaaatcaaaggaaacatggtcatgtttttacctgcaaactaatgggaaaatatgtccatttcatcacaaatcccttgtcataccataaggtgttgtgccatggaaaatactttgattggaaaaaatttcactttgctacttctgcaaaggcttttgggcacagaagcattgacccaaaggatggaaataccactgaaaacataaacaacactttcatcaaaaccctgcagggcaatgccttgaattccctcacggaaagcatgatggaaaacctccaacgtatcatgagacctccagtcttctctaactcaaagaccgctgcctgggtgacagaagggatgtattccttctgctaccgagtgatgtttgaagctgggtatttaactatctttggcagggatcttacaaggcaagacacacagaaagcacatattctaaacaatcttgacaacttcaagcagttcgacaaagtctttccagccctggtagcaggcctccccattcacatgttcaggaccgcgcacagtgcccgggagaaactggcagagagcttgaggcacgagaacctccaaaagagggaaagcgtctcagaactgatcagactgcgcatgtttctcaatgacactttgtccacctttgatgacctggagaaggccaagacgcacctcgtggtcctctgggcatcgcaagcaaacaccattccagcaactttctggagtttatttcaaatgattaggaacccggaagcaatgaaagcagctactgaagaagtgaaaagaacattagagaatgctggtcaaaaagtcagcttggaaggcaatcccatttgtttgagtcaaacacaactgaatgacctgccagtattagaaagcataatcaaggaatcactgaggctttccagtgcctccctcaacattcggacagctaaggaggatttcactttgcaccttgaggacggttcctacaacatccgaaaagatgacatcatagctctttacccacagttaatgcacttagatccagaaatctacccagaccctttgatttttaaatatgataggtatcttgatgaaaacgggaagacaaagactaccttctactgtaatggactcaaattaaagtattactacatgccctttggatcaggagctacaatatgccctggaagagtgtttgctatccacgaaatcaagcaatttttggttttgatgctttcttattttgaactggagcttgtcgagggccaagataaatgtccgcctttggaccagtcccgggcaggcttgggcattttgccgccattatatgacattgagtttaaatataaattcaagcatttgtgaatacgtggctgaaataagaggacactagatgatattacaggactgcagaacaccatcaccacacagtccctttggataaatgcatttagtggtggtagaaatgattcaccaggtccaatgttgttcaccaatgcttgcttgtgaatcttaatattttggtgacagtttccagatggtgtcgcagactgtgctagtgaaaagaactagtttctaggagcacgataatttgttttcatctgtatgagtccatgaatgttcatatagccaggggttgaagtttatttttttcagaggaaaacaccttttttttttttcccccccccaaaatgaagatacacattccagccaggtattgtagcaggcacctgtagtcttagctactcgagaggccaaagaaggaggatggcttgagcccaggagttcaagactagcctggacagcttagtgagaccccgtctctaaagaaaagatacgtattctaattggcagattgttttttcctaaggaaactgctttatttttataaaactgcccaacaattatgaaacatgttcaaattcacgttctagtgaaactgcattatttttttactagatgttggggttcttcaggtgtgatcatatatcataaaggatatttcaaatgattatgattagttatgtcttttaataaaaaggaaatacttttcaactttttatatatccaaaattcagggctttaaaaatgattattttgatttcccaaaaacactaaaggtggttttaatattttccctttatgttttaacttattgttgctgaaaactctatgtccagctttaactatcttctctgtatttttatttcatttcatattaatgagaagagtttttttcagagattaaaaaaggcagtttttctgttattgttaaatacacactatcactgaacaaatgtagcttttatgtgatctgttttaaagttaaaaccggatggaaatagccgtttgaaagctttggttatgaaacatgcggagtgtattaagtacggcttgacattatgttttatttaaatgctttttatcgctaaatgacttgcagatgaaaaaaaactaaggtggcctgagagtttaaatgctgtgtacaacaatgctttgataatatattttaagtatgagttatcagctatatgtcaattgatatttctgtgcagtatttatatgtaaattatatttacctttttgcttattttataaatattaagaaagtattctaacatttcataattttgaaatgattcatctttcagaaataaaagtatgaatcta

SEQ ID NO: 8 - protein, 504 aa, Macaca fascicularis
MMTISLIWGIAIAACCCLWLILGIRRRQTGEPPLENGLIPYLGCALQFGANPLEFLRANQRKHGHVFTCKLMGKYVHFITNPLSYHKVLCHGKYFDWKKFHFATSAKAFGHRSIDPKDGNTTENINNTFIKTLQGNALNSLTESMMENLQRIMRPPVFSNSKTAAWVTEGMYSFCYRVMFEAGYLTIFGRDLTRQDTQKAHILNNLDNFKQFDKVFPALVAGLPIHMFRTAHSAREKLAESLRHENLQKRESVSELIRLRMFLNDTLSTFDDLEKAKTHLVVLWASQANTIPATFWSLFQMIRNPEAMKAATEEVKRTLENAGQKVSLEGNPICLSQTQLNDLPVLESIIKESLRLSSASLNIRTAKEDFTLHLEDGSYNIRKDDIIALYPQLMHLDPEIYPDPLIFKYDRYLDENGKTKTTFYCNGLKLKYYYMPFGSGATICPGRVFAIHEIKQFLVLMLSYFELELVEGQDKCPPLDQSRAGLGILPPLYDIEFKYKFKHL

SEQ ID NO: 9 - RNA, 19 nt, synthetic construct
  source 1..19: mol_type = other RNA
cttcctcagagattttggc

SEQ ID NO: 10 - RNA, 19 nt, synthetic construct
  source 1..19: mol_type = other RNA
cagagattttggcctagat

SEQ ID NO: 11 - RNA, 19 nt, synthetic construct
  source 1..19: mol_type = other RNA
agagattttggcctagatt

SEQ ID NO: 12 - RNA, 19 nt, synthetic construct
  source 1..19: mol_type = other RNA
gagattttggcctagattt

SEQ ID NO: 13 - RNA, 19 nt, synthetic construct
  source 1..19: mol_type = other RNA
agattttggcctagatttg

SEQ ID NO: 14 - RNA, 19 nt, synthetic construct
  source 1..19: mol_type = other RNA
attttggcctagatttgca

SEQ ID NO: 15 - RNA, 19 nt, synthetic construct
  source 1..19: mol_type = other RNA
gcatgctgttgtctatggc

SEQ ID NO: 16 - RNA, 19 nt, synthetic construct
  source 1..19: mol_type = other RNA
ctgttgtctatggcttatt

SEQ ID NO: 17 - RNA, 19 nt, synthetic construct
  source 1..19: mol_type = other RNA
tgttgtctatggcttattc

SEQ ID NO: 18 - RNA, 19 nt, synthetic construct
  source 1..19: mol_type = other RNA
gttgtctatggcttattct

SEQ ID NO: 19 - RNA, 19 nt, synthetic construct
  source 1..19: mol_type = other RNA
ttgtctatggcttattctt

SEQ ID NO: 20 - RNA, 19 nt, synthetic construct
  source 1..19: mol_type = other RNA
gtctatggcttattcttgg

SEQ ID NO: 21 - RNA, 19 nt, synthetic construct
  source 1..19: mol_type = other RNA
tctatggcttattcttgga

SEQ ID NO: 22 - RNA, 19 nt, synthetic construct
  source 1..19: mol_type = other RNA
ctatggcttattcttggaa

SEQ ID NO: 23 - RNA, 19 nt, synthetic construct
  source 1..19: mol_type = other RNA
tatggcttattcttggaat

SEQ ID NO: 24 - RNA, 19 nt, synthetic construct
  source 1..19: mol_type = other RNA
ggagaaggcaaacgggtga

SEQ ID NO: 25 - RNA, 19 nt, synthetic construct
  source 1..19: mol_type = other RNA
agaaggcaaacgggtgaac

SEQ ID NO: 26 - RNA, 19 nt, synthetic construct
  source 1..19: mol_type = other RNA
gaaggcaaacgggtgaacc

SEQ ID NO: 27 - RNA, 19 nt, synthetic construct
  source 1..19: mol_type = other RNA
aaggcaaacgggtgaacca

SEQ ID NO: 28 - RNA, 19 nt, synthetic construct
  source 1..19: mol_type = other RNA
ttccatacctgggctgtgc

SEQ ID NO: 29 - RNA, 19 nt, synthetic construct
  source 1..19: mol_type = other RNA
tccatacctgggctgtgct

SEQ ID NO: 30 - RNA, 19 nt, synthetic construct
  source 1..19: mol_type = other RNA
ccatacctgggctgtgctc

SEQ ID NO: 31 - RNA, 19 nt, synthetic construct
  source 1..19: mol_type = other RNA
ctgcaatttggtgccaatc

SEQ ID NO: 32 - RNA, 19 nt, synthetic construct
  source 1..19: mol_type = other RNA
gcaatttggtgccaatcct

SEQ ID NO: 33 - RNA, 19 nt, synthetic construct
  source 1..19: mol_type = other RNA
ggtgccaatcctcttgagt

SEQ ID NO: 34 - RNA, 19 nt, synthetic construct
  source 1..19: mol_type = other RNA
ccaatcctcttgagttcct

SEQ ID NO: 35 - RNA, 19 nt, synthetic construct
  source 1..19: mol_type = other RNA
ttgagttcctcagagcaaa

SEQ ID NO: 36 - RNA, 19 nt, synthetic construct
  source 1..19: mol_type = other RNA
gagttcctcagagcaaatc

SEQ ID NO: 37 - RNA, 19 nt, synthetic construct
  source 1..19: mol_type = other RNA
tcctcagagcaaatcaaag

SEQ ID NO: 38 - RNA, 19 nt, synthetic construct
  source 1..19: mol_type = other RNA
cctcagagcaaatcaaagg

SEQ ID NO: 39 - RNA, 19 nt, synthetic construct
  source 1..19: mol_type = other RNA
agcaaatcaaaggaaacat

SEQ ID NO: 40 - RNA, 19 nt, synthetic construct
  source 1..19: mol_type = other RNA
caaatcaaaggaaacatgg

SEQ ID NO: 41 - RNA, 19 nt, synthetic construct
  source 1..19: mol_type = other RNA
tcaaaggaaacatggtcat

SEQ ID NO: 42 - RNA, 19 nt, synthetic construct
  source 1..19: mol_type = other RNA
caaaggaaacatggtcatg

SEQ ID NO: 43 - RNA, 19 nt, synthetic construct
  source 1..19: mol_type = other RNA
aaaggaaacatggtcatgt

SEQ ID NO: 44 - RNA, 19 nt, synthetic construct
  source 1..19: mol_type = other RNA
aaggaaacatggtcatgtt

SEQ ID NO: 45 - RNA, 19 nt, synthetic construct
  source 1..19: mol_type = other RNA
aggaaacatggtcatgttt

SEQ ID NO: 46 - RNA, 19 nt, synthetic construct
  source 1..19: mol_type = other RNA
acatggtcatgtttttacc

SEQ ID NO: 47 - RNA, 19 nt, synthetic construct
  source 1..19: mol_type = other RNA
atggtcatgtttttacctg

SEQ ID NO: 48 - RNA, 19 nt, synthetic construct
  source 1..19: mol_type = other RNA
tggtcatgtttttacctgc

SEQ ID NO: 49 - RNA, 19 nt, synthetic construct
  source 1..19: mol_type = other RNA
tttttacctgcaaactaat

SEQ ID NO: 50 - RNA, 19 nt, synthetic construct
  source 1..19: mol_type = other RNA
tttacctgcaaactaatgg

SEQ ID NO: 51 - RNA, 19 nt, synthetic construct
  source 1..19: mol_type = other RNA
tacctgcaaactaatggga

SEQ ID NO: 52 - RNA, 19 nt, synthetic construct
  source 1..19: mol_type = other RNA
acctgcaaactaatgggaa

SEQ ID NO: 53 - RNA, 19 nt, synthetic construct
  source 1..19: mol_type = other RNA
cctgcaaactaatgggaaa

SEQ ID NO: 54 - RNA, 19 nt, synthetic construct
  source 1..19: mol_type = other RNA
gtccatttcatcacaaatc

SEQ ID NO: 55 - RNA, 19 nt, synthetic construct
  source 1..19: mol_type = other RNA
tccatttcatcacaaatcc

SEQ ID NO: 56 - RNA, 19 nt, synthetic construct
  source 1..19: mol_type = other RNA
catttcatcacaaatccct

SEQ ID NO: 57 - RNA, 19 nt, synthetic construct
  source 1..19: mol_type = other RNA
atcacaaatcccttgtcat

SEQ ID NO: 58 - RNA, 19 nt, synthetic construct
  source 1..19: mol_type = other RNA
cacaaatcccttgtcatac

SEQ ID NO: 59 - RNA, 19 nt, synthetic construct
  source 1..19: mol_type = other RNA
acaaatcccttgtcatacc

SEQ ID NO: 60 - RNA, 19 nt, synthetic construct
  source 1..19: mol_type = other RNA
caaatcccttgtcatacca

SEQ ID NO: 61 - RNA, 19 nt, synthetic construct
  source 1..19: mol_type = other RNA
aaatcccttgtcataccat

SEQ ID NO: 62 - RNA, 19 nt, synthetic construct
  source 1..19: mol_type = other RNA
cccttgtcataccataagg

SEQ ID NO: 63 - RNA, 19 nt, synthetic construct
  source 1..19: mol_type = other RNA
ccttgtcataccataaggt

SEQ ID NO: 64 - RNA, 19 nt, synthetic construct
  source 1..19: mol_type = other RNA
cttgtcataccataaggtg

SEQ ID NO: 65 - RNA, 19 nt, synthetic construct
  source 1..19: mol_type = other RNA
ttgtcataccataaggtgt

SEQ ID NO: 66 - RNA, 19 nt, synthetic construct
  source 1..19: mol_type = other RNA
tgtcataccataaggtgtt

SEQ ID NO: 67 - RNA, 19 nt, synthetic construct
  source 1..19: mol_type = other RNA
tcataccataaggtgttgt

SEQ ID NO: 68 - RNA, 19 nt, synthetic construct
  source 1..19: mol_type = other RNA
accataaggtgttgtgcca

SEQ ID NO: 69 - RNA, 19 nt, synthetic construct
  source 1..19: mol_type = other RNA
aaatttcactttgctactt

SEQ ID NO: 70 - RNA, 19 nt, synthetic construct
  source 1..19: mol_type = other RNA
tttcactttgctacttctg

SEQ ID NO: 71 - RNA, 19 nt, synthetic construct
  source 1..19: mol_type = other RNA
gctacttctgcgaaggcat

SEQ ID NO: 72 - RNA, 19 nt, synthetic construct
  source 1..19: mol_type = other RNA
acttctgcgaaggcatttg

SEQ ID NO: 73 - RNA, 19 nt, synthetic construct
  source 1..19: mol_type = other RNA
ttctgcgaaggcatttggg

SEQ ID NO: 74 - RNA, 19 nt, synthetic construct
  source 1..19: mol_type = other RNA
tttgggcacagaagcattg

SEQ ID NO: 75 - RNA, 19 nt, synthetic construct
  source 1..19: mol_type = other RNA
tgggcacagaagcattgac

SEQ ID NO: 76 - RNA, 19 nt, synthetic construct
  source 1..19: mol_type = other RNA
ggcacagaagcattgaccc

SEQ ID NO: 77 - RNA, 19 nt, synthetic construct
  source 1..19: mol_type = other RNA
gccttgaattccctcacgg

SEQ ID NO: 78 - RNA, 19 nt, synthetic construct
  source 1..19: mol_type = other RNA
ccttgaattccctcacgga

SEQ ID NO: 79 - RNA, 19 nt, synthetic construct
  source 1..19: mol_type = other RNA
cttgaattccctcacggaa

SEQ ID NO: 80 - RNA, 19 nt, synthetic construct
  source 1..19: mol_type = other RNA
ttgaattccctcacggaaa

SEQ ID NO: 81 - RNA, 19 nt, synthetic construct
  source 1..19: mol_type = other RNA
tgaattccctcacggaaag

SEQ ID NO: 82 - RNA, 19 nt, synthetic construct
  source 1..19: mol_type = other RNA
ttccctcacggaaagcatg

SEQ ID NO: 83 - RNA, 19 nt, synthetic construct
  source 1..19: mol_type = other RNA
ccctcacggaaagcatgat

SEQ ID NO: 84 - RNA, 19 nt, synthetic construct
  source 1..19: mol_type = other RNA
ctcacggaaagcatgatgg

SEQ ID NO: 85 - RNA, 19 nt, synthetic construct
  source 1..19: mol_type = other RNA
cacggaaagcatgatggaa

SEQ ID NO: 86 - RNA, 19 nt, synthetic construct
  source 1..19: mol_type = other RNA
atggaaaacctccaacgta

SEQ ID NO: 87 - RNA, 19 nt, synthetic construct
  source 1..19: mol_type = other RNA
ggaaaacctccaacgtatc

SEQ ID NO: 88 - RNA, 19 nt, synthetic construct
  source 1..19: mol_type = other RNA
aaaacctccaacgtatcat

SEQ ID NO: 89 - RNA, 19 nt, synthetic construct
  source 1..19: mol_type = other RNA
aaacctccaacgtatcatg

SEQ ID NO: 90 - RNA, 19 nt, synthetic construct
  source 1..19: mol_type = other RNA
aacctccaacgtatcatga

SEQ ID NO: 91 - RNA, 19 nt, synthetic construct
  source 1..19: mol_type = other RNA
cctccaacgtatcatgaga

SEQ ID NO: 92 - RNA, 19 nt, synthetic construct
  source 1..19: mol_type = other RNA
ctccaacgtatcatgagac

SEQ ID NO: 93 - RNA, 19 nt, synthetic construct
  source 1..19: mol_type = other RNA
tccaacgtatcatgagacc

SEQ ID NO: 94 - RNA, 19 nt, synthetic construct
  source 1..19: mol_type = other RNA
ccaacgtatcatgagacct

SEQ ID NO: 95 - RNA, 19 nt, synthetic construct
  source 1..19: mol_type = other RNA
caacgtatcatgagacctc

SEQ ID NO: 96 - RNA, 19 nt, synthetic construct
  source 1..19: mol_type = other RNA
aacgtatcatgagacctcc

SEQ ID NO: 97 - RNA, 19 nt, synthetic construct
  source 1..19: mol_type = other RNA
ctctaactcaaagaccgct

SEQ ID NO: 98 - RNA, 19 nt, synthetic construct
  source 1..19: mol_type = other RNA
accgctgcctgggtgacag

SEQ ID NO: 99 - RNA, 19 nt, synthetic construct
  source 1..19: mol_type = other RNA
gggtgacagaagggatgta

SEQ ID NO: 100 - RNA, 19 nt, synthetic construct
  source 1..19: mol_type = other RNA
ggtgacagaagggatgtat

SEQ ID NO: 101 - RNA, 19 nt, synthetic construct
  source 1..19: mol_type = other RNA
gtgacagaagggatgtatt

SEQ ID NO: 102 - RNA, 19 nt, synthetic construct
  source 1..19: mol_type = other RNA
ttctgctaccgagtgatgt

SEQ ID NO: 103 - RNA, 19 nt, synthetic construct
  source 1..19: mol_type = other RNA
ctgctaccgagtgatgttt

SEQ ID NO: 104 - RNA, 19 nt, synthetic construct
  source 1..19: mol_type = other RNA
tgctaccgagtgatgtttg

SEQ ID NO: 105 - RNA, 19 nt, synthetic construct
  source 1..19: mol_type = other RNA
gctaccgagtgatgtttga

SEQ ID NO: 106 - RNA, 19 nt, synthetic construct
  source 1..19: mol_type = other RNA
ccgagtgatgtttgaagct

SEQ ID NO: 107 - RNA, 19 nt, synthetic construct
  source 1..19: mol_type = other RNA
cgagtgatgtttgaagctg

SEQ ID NO: 108 - RNA, 19 nt, synthetic construct
  source 1..19: mol_type = other RNA
gagtgatgtttgaagctgg

SEQ ID NO: 109 - RNA, 19 nt, synthetic construct
  source 1..19: mol_type = other RNA
gtttgaagctgggtattta

SEQ ID NO: 110 - RNA, 19 nt, synthetic construct
  source 1..19: mol_type = other RNA
tgaagctgggtatttaact

SEQ ID NO: 111 - RNA, 19 nt, synthetic construct
  source 1..19: mol_type = other RNA
gaagctgggtatttaacta

SEQ ID NO: 112 - RNA, 19 nt, synthetic construct
  source 1..19: mol_type = other RNA
aagctgggtatttaactat

SEQ ID NO: 113 - RNA, 19 nt, synthetic construct
  source 1..19: mol_type = other RNA
agctgggtatttaactatc

SEQ ID NO: 114 - RNA, 19 nt, synthetic construct
  source 1..19: mol_type = other RNA
gctgggtatttaactatct

SEQ ID NO: 115 - RNA, 19 nt, synthetic construct
  source 1..19: mol_type = other RNA
ctgggtatttaactatctt

SEQ ID NO: 116 - RNA, 19 nt, synthetic construct
  source 1..19: mol_type = other RNA
gggtatttaactatctttg

SEQ ID NO: 117 - RNA, 19 nt, synthetic construct
  source 1..19: mol_type = other RNA
ggtatttaactatctttgg

SEQ ID NO: 118 - RNA, 19 nt, synthetic construct
  source 1..19: mol_type = other RNA
cacacagaaagcacatatt

SEQ ID NO: 119 - RNA, 19 nt, synthetic construct
  source 1..19: mol_type = other RNA
gcacatattctaaacaatc

SEQ ID NO: 120 - RNA, 19 nt, synthetic construct
  source 1..19: mol_type = other RNA
acatattctaaacaatctt

SEQ ID NO: 121 - RNA, 19 nt, synthetic construct
  source 1..19: mol_type = other RNA
catattctaaacaatcttg

SEQ ID NO: 122 - RNA, 19 nt, synthetic construct
  source 1..19: mol_type = other RNA
atattctaaacaatcttga

SEQ ID NO: 123 - RNA, 19 nt, synthetic construct
  source 1..19: mol_type = other RNA
attctaaacaatcttgaca

SEQ ID NO: 124 - RNA, 19 nt, synthetic construct
  source 1..19: mol_type = other RNA
ttctaaacaatcttgacaa

SEQ ID NO: 125 - RNA, 19 nt, synthetic construct
  source 1..19: mol_type = other RNA
tctaaacaatcttgacaac

SEQ ID NO: 126 - RNA, 19 nt, synthetic construct
  source 1..19: mol_type = other RNA
taaacaatcttgacaactt

SEQ ID NO: 127 - RNA, 19 nt, synthetic construct
  source 1..19: mol_type = other RNA
atcttgacaacttcaagca

SEQ ID NO: 128 - RNA, 19 nt, synthetic construct
  source 1..19: mol_type = other RNA
ttccagccctggtagcagg

SEQ ID NO: 129 - RNA, 19 nt, synthetic construct
  source 1..19: mol_type = other RNA
gagaaactggcagagagct

SEQ ID NO: 130 - RNA, 19 nt, synthetic construct
  source 1..19: mol_type = other RNA
cagagagcttgaggcacga

SEQ ID NO: 131 - RNA, 19 nt, synthetic construct
  source 1..19: mol_type = other RNA
cttgaggcacgagaacctc

SEQ ID NO: 132 - RNA, 19 nt, synthetic construct
  source 1..19: mol_type = other RNA
tgcgcatgtttctcaatga

SEQ ID NO: 133 - RNA, 19 nt, synthetic construct
  source 1..19: mol_type = other RNA
gcatgtttctcaatgacac

SEQ ID NO: 134 - RNA, 19 nt, synthetic construct
  source 1..19: mol_type = other RNA
atgtttctcaatgacactt

SEQ ID NO: 135 - RNA, 19 nt, synthetic construct
  source 1..19: mol_type = other RNA
ttctcaatgacactttgtc

SEQ ID NO: 136 - RNA, 19 nt, synthetic construct
  source 1..19: mol_type = other RNA
tctcaatgacactttgtcc

SEQ ID NO: 137 - RNA, 19 nt, synthetic construct
  source 1..19: mol_type = other RNA
ctcaatgacactttgtcca

SEQ ID NO: 138 - RNA, 19 nt, synthetic construct
  source 1..19: mol_type = other RNA
actttgtccacctttgatg

SEQ ID NO: 139 - RNA, 19 nt, synthetic construct
  source 1..19: mol_type = other RNA
ctttgtccacctttgatga

SEQ ID NO: 140 - RNA, 19 nt, synthetic construct
  source 1..19: mol_type = other RNA
acctcgtggtcctctgggc

SEQ ID NO: 141 - RNA, 19 nt, synthetic construct
  source 1..19: mol_type = other RNA
ctcgtggtcctctgggcat

SEQ ID NO: 142 - RNA, 19 nt, synthetic construct
  source 1..19: mol_type = other RNA
tcgtggtcctctgggcatc

SEQ ID NO: 143 - RNA, 19 nt, synthetic construct
  source 1..19: mol_type = other RNA
cgtggtcctctgggcatcg

SEQ ID NO: 144 - RNA, 19 nt, synthetic construct
  source 1..19: mol_type = other RNA
gtggtcctctgggcatcgc

SEQ ID NO: 145 - RNA, 19 nt, synthetic construct
  source 1..19: mol_type = other RNA
ctctgggcatcgcaagcaa

SEQ ID NO: 146 - RNA, 19 nt, synthetic construct
  source 1..19: mol_type = other RNA
tgggcatcgcaagcaaaca

SEQ ID NO: 147 - RNA, 19 nt, synthetic construct
  source 1..19: mol_type = other RNA
gggcatcgcaagcaaacac

SEQ ID NO: 148 - RNA, 19 nt, synthetic construct
  source 1..19: mol_type = other RNA
ggcatcgcaagcaaacacc

SEQ ID NO: 149 - RNA, 19 nt, synthetic construct
  source 1..19: mol_type = other RNA
atcgcaagcaaacaccatt

SEQ ID NO: 150 - RNA, 19 nt, synthetic construct
  source 1..19: mol_type = other RNA
tcgcaagcaaacaccattc

SEQ ID NO: 151 - RNA, 19 nt, synthetic construct
  source 1..19: mol_type = other RNA
ctggagtttatttcaaatg

SEQ ID NO: 152 - RNA, 19 nt, synthetic construct
  source 1..19: mol_type = other RNA
agtttatttcaaatgatta

SEQ ID NO: 153 - RNA, 19 nt, synthetic construct
  source 1..19: mol_type = other RNA
gtttatttcaaatgattag

SEQ ID NO: 154 - RNA, 19 nt, synthetic construct
  source 1..19: mol_type = other RNA
tttatttcaaatgattagg

SEQ ID NO: 155 - RNA, 19 nt, synthetic construct
  source 1..19: mol_type = other RNA
ttatttcaaatgattagga

SEQ ID NO: 156 - RNA, 19 nt, synthetic construct
  source 1..19: mol_type = other RNA
agaagcaatgaaagcagct

SEQ ID NO: 157 - RNA, 19 nt, synthetic construct
  source 1..19: mol_type = other RNA
aagcaatgaaagcagctac

SEQ ID NO: 158 - RNA, 19 nt, synthetic construct
  source 1..19: mol_type = other RNA
agcaatgaaagcagctact

SEQ ID NO: 159 - RNA, 19 nt, synthetic construct
  source 1..19: mol_type = other RNA
tgaaagcagctactgaaga

SEQ ID NO: 160 - RNA, 19 nt, synthetic construct
  source 1..19: mol_type = other RNA
gaaagcagctactgaagaa

SEQ ID NO: 161 - RNA, 19 nt, synthetic construct
  source 1..19: mol_type = other RNA
agcagctactgaagaagtg

SEQ ID NO: 162 - RNA, 19 nt, synthetic construct
  source 1..19: mol_type = other RNA
gcagctactgaagaagtga

SEQ ID NO: 163 - RNA, 19 nt, synthetic construct
  source 1..19: mol_type = other RNA
cagctactgaagaagtgaa

SEQ ID NO: 164 - RNA, 19 nt, synthetic construct
  source 1..19: mol_type = other RNA
agctactgaagaagtgaaa

SEQ ID NO: 165 - RNA, 19 nt, synthetic construct
  source 1..19: mol_type = other RNA
gctactgaagaagtgaaaa

SEQ ID NO: 166 - RNA, 19 nt, synthetic construct
  source 1..19: mol_type = other RNA
gaagtgaaaagaacattag

SEQ ID NO: 167 - RNA, 19 nt, synthetic construct
  source 1..19: mol_type = other RNA
aagtgaaaagaacattaga

SEQ ID NO: 168 - RNA, 19 nt, synthetic construct
  source 1..19: mol_type = other RNA
agtgaaaagaacattagag

SEQ ID NO: 169 - RNA, 19 nt, synthetic construct
  source 1..19: mol_type = other RNA
aaaagaacattagagaatg

SEQ ID NO: 170 - RNA, 19 nt, synthetic construct
  source 1..19: mol_type = other RNA
aaagaacattagagaatgc

SEQ ID NO: 171 - RNA, 19 nt, synthetic construct
  source 1..19: mol_type = other RNA
aagaacattagagaatgct

SEQ ID NO: 172 - RNA, 19 nt, synthetic construct
  source 1..19: mol_type = other RNA
cattagagaatgctggtca

SEQ ID NO: 173 - RNA, 19 nt, synthetic construct
  source 1..19: mol_type = other RNA
attagagaatgctggtcaa

SEQ ID NO: 174 - RNA, 19 nt, synthetic construct
  source 1..19: mol_type = other RNA
ttagagaatgctggtcaaa

SEQ ID NO: 175 - RNA, 19 nt, synthetic construct
  source 1..19: mol_type = other RNA
tagagaatgctggtcaaaa

SEQ ID NO: 176 - RNA, 19 nt, synthetic construct
  source 1..19: mol_type = other RNA
aatgctggtcaaaaagtca

SEQ ID NO: 177 - RNA, 19 nt, synthetic construct
  source 1..19: mol_type = other RNA
atgctggtcaaaaagtcag

SEQ ID NO: 178 - RNA, 19 nt, synthetic construct
  source 1..19: mol_type = other RNA
gctggtcaaaaagtcagct

SEQ ID NO: 179 - RNA, 19 nt, synthetic construct
  source 1..19: mol_type = other RNA
aaaaagtcagcttggaagg

SEQ ID NO: 180 - RNA, 19 nt, synthetic construct
  source 1..19: mol_type = other RNA
aagtcagcttggaaggcaa

SEQ ID NO: 181 - RNA, 19 nt, synthetic construct
  source 1..19: mol_type = other RNA
tcagcttggaaggcaatcc

SEQ ID NO: 182 - RNA, 19 nt, synthetic construct
  source 1..19: mol_type = other RNA
tgaatgacctgccagtatt

SEQ ID NO: 183 - RNA, 19 nt, synthetic construct
  source 1..19: mol_type = other RNA
atgacctgccagtattaga

SEQ ID NO: 184 - RNA, 19 nt, synthetic construct
  source 1..19: mol_type = other RNA
tccagtgcctccctcaaca

SEQ ID NO: 185 - RNA, 19 nt, synthetic construct
  source 1..19: mol_type = other RNA
catccggacagctaaggag

SEQ ID NO: 186 - RNA, 19 nt, synthetic construct
  source 1..19: mol_type = other RNA
atccggacagctaaggagg

SEQ ID NO: 187 - RNA, 19 nt, synthetic construct
  source 1..19: mol_type = other RNA
cggacagctaaggaggatt

SEQ ID NO: 188 - RNA, 19 nt, synthetic construct
  source 1..19: mol_type = other RNA
acagctaaggaggatttca

SEQ ID NO: 189 - RNA, 19 nt, synthetic construct
  source 1..19: mol_type = other RNA
agctaaggaggatttcact

SEQ ID NO: 190 - RNA, 19 nt, synthetic construct
  source 1..19: mol_type = other RNA
ctaaggaggatttcacttt

SEQ ID NO: 191 - RNA, 19 nt, synthetic construct
  source 1..19: mol_type = other RNA
aggaggatttcactttgca

SEQ ID NO: 192 - RNA, 19 nt, synthetic construct
  source 1..19: mol_type = other RNA
aggatttcactttgcacct

SEQ ID NO: 193 - RNA, 19 nt, synthetic construct
  source 1..19: mol_type = other RNA
ggatttcactttgcacctt

SEQ ID NO: 194 - RNA, 19 nt, synthetic construct
  source 1..19: mol_type = other RNA
tcactttgcaccttgagga

SEQ ID NO: 195 - RNA, 19 nt, synthetic construct
  source 1..19: mol_type = other RNA
ctttgcaccttgaggacgg

SEQ ID NO: 196 - RNA, 19 nt, synthetic construct
  source 1..19: mol_type = other RNA
tttgcaccttgaggacggt

SEQ ID NO: 197 - RNA, 19 nt, synthetic construct
  source 1..19: mol_type = other RNA
aggacggttcctacaacat

SEQ ID NO: 198 - RNA, 19 nt, synthetic construct
  source 1..19: mol_type = other RNA
gacggttcctacaacatcc

SEQ ID NO: 199 - RNA, 19 nt, synthetic construct
  source 1..19: mol_type = other RNA
ggttcctacaacatccgaa

SEQ ID NO: 200 - RNA, 19 nt, synthetic construct
  source 1..19: mol_type = other RNA
ttcctacaacatccgaaaa

SEQ ID NO: 201 - RNA, 19 nt, synthetic construct
  source 1..19: mol_type = other RNA
tacaacatccgaaaagatg

SEQ ID NO: 202 - RNA, 19 nt, synthetic construct
  source 1..19: mol_type = other RNA
acaacatccgaaaagatga

SEQ ID NO: 203 - RNA, 19 nt, synthetic construct
  source 1..19: mol_type = other RNA
aacatccgaaaagatgaca

SEQ ID NO: 204 - RNA, 19 nt, synthetic construct
  source 1..19: mol_type = other RNA
acatccgaaaagatgacat

SEQ ID NO: 205 - RNA, 19 nt, synthetic construct
  source 1..19: mol_type = other RNA
catccgaaaagatgacatc

SEQ ID NO: 206 - RNA, 19 nt, synthetic construct
  source 1..19: mol_type = other RNA
tccgaaaagatgacatcat

SEQ ID NO: 207 - RNA, 19 nt, synthetic construct
  source 1..19: mol_type = other RNA
cgaaaagatgacatcatag

SEQ ID NO: 208 - RNA, 19 nt, synthetic construct
  source 1..19: mol_type = other RNA
aaagatgacatcatagctc

SEQ ID NO: 209 - RNA, 19 nt, synthetic construct
  source 1..19: mol_type = other RNA
agatgacatcatagctctt

SEQ ID NO: 210 - RNA, 19 nt, synthetic construct
  source 1..19: mol_type = other RNA
gatgacatcatagctcttt

SEQ ID NO: 211 - RNA, 19 nt, synthetic construct
  source 1..19: mol_type = other RNA
tgacatcatagctctttac

SEQ ID NO: 212 - RNA, 19 nt, synthetic construct
  source 1..19: mol_type = other RNA
agctctttacccacagtta

SEQ ID NO: 213 - RNA, 19 nt, synthetic construct
  source 1..19: mol_type = other RNA
gctctttacccacagttaa

SEQ ID NO: 214 - RNA, 19 nt, synthetic construct
  source 1..19: mol_type = other RNA
ctctttacccacagttaat

SEQ ID NO: 215 - RNA, 19 nt, synthetic construct
  source 1..19: mol_type = other RNA
tctttacccacagttaatg

SEQ ID NO: 216 - RNA, 19 nt, synthetic construct
  source 1..19: mol_type = other RNA
ctttacccacagttaatgc

SEQ ID NO: 217 - RNA, 19 nt, synthetic construct
  source 1..19: mol_type = other RNA
tttacccacagttaatgca

SEQ ID NO: 218 - RNA, 19 nt, synthetic construct
  source 1..19: mol_type = other RNA
tacccacagttaatgcact

SEQ ID NO: 219 - RNA, 19 nt, synthetic construct
  source 1..19: mol_type = other RNA
ccacagttaatgcacttag

SEQ ID NO: 220 - RNA, 19 nt, synthetic construct
  source 1..19: mol_type = other RNA
cacagttaatgcacttaga

SEQ ID NO: 221 - RNA, 19 nt, synthetic construct
  source 1..19: mol_type = other RNA
acagttaatgcacttagat

SEQ ID NO: 222 - RNA, 19 nt, synthetic construct
  source 1..19: mol_type = other RNA
cagttaatgcacttagatc

SEQ ID NO: 223 - RNA, 19 nt, synthetic construct
  source 1..19: mol_type = other RNA
agttaatgcacttagatcc

SEQ ID NO: 224 - RNA, 19 nt, synthetic construct
  source 1..19: mol_type = other RNA
gttaatgcacttagatcca

SEQ ID NO: 225 - RNA, 19 nt, synthetic construct
  source 1..19: mol_type = other RNA
ttaatgcacttagatccag

SEQ ID NO: 226 - RNA, 19 nt, synthetic construct
  source 1..19: mol_type = other RNA
cacttagatccagaaatct

SEQ ID NO: 227 - RNA, 19 nt, synthetic construct
  source 1..19: mol_type = other RNA
acttagatccagaaatcta

SEQ ID NO: 228 - RNA, 19 nt, synthetic construct
  source 1..19: mol_type = other RNA
aaatctacccagacccttt

SEQ ID NO: 229 - RNA, 19 nt, synthetic construct
  source 1..19: mol_type = other RNA
ttttaaatatgataggtat

SEQ ID NO: 230 - RNA, 19 nt, synthetic construct
  source 1..19: mol_type = other RNA
ttaaatatgataggtatct

SEQ ID NO: 231 - RNA, 19 nt, synthetic construct
  source 1..19: mol_type = other RNA
taaatatgataggtatctt

SEQ ID NO: 232 - RNA, 19 nt, synthetic construct
  source 1..19: mol_type = other RNA
aatatgataggtatcttga

SEQ ID NO: 233 - RNA, 19 nt, synthetic construct
  source 1..19: mol_type = other RNA
tatgataggtatcttgatg

SEQ ID NO: 234 - RNA, 19 nt, synthetic construct
  source 1..19: mol_type = other RNA
atgataggtatcttgatga

SEQ ID NO: 235 - RNA, 19 nt, synthetic construct
  source 1..19: mol_type = other RNA
tgataggtatcttgatgaa

SEQ ID NO: 236 - RNA, 19 nt, synthetic construct
  source 1..19: mol_type = other RNA
gataggtatcttgatgaaa

SEQ ID NO: 237 - RNA, 19 nt, synthetic construct
  source 1..19: mol_type = other RNA
aggtatcttgatgaaaacg

SEQ ID NO: 238 - RNA, 19 nt, synthetic construct
  source 1..19: mol_type = other RNA
ggtatcttgatgaaaacgg

SEQ ID NO: 239 - RNA, 19 nt, synthetic construct
  source 1..19: mol_type = other RNA
gtatcttgatgaaaacggg

SEQ ID NO: 240 - RNA, 19 nt, synthetic construct
  source 1..19: mol_type = other RNA
tatcttgatgaaaacggga

SEQ ID NO: 241 - RNA, 19 nt, synthetic construct
  source 1..19: mol_type = other RNA
atcttgatgaaaacgggaa

SEQ ID NO: 242 - RNA, 19 nt, synthetic construct
  source 1..19: mol_type = other RNA
tcttgatgaaaacgggaag

SEQ ID NO: 243 - RNA, 19 nt, synthetic construct
  source 1..19: mol_type = other RNA
cttgatgaaaacgggaaga

SEQ ID NO: 244 - RNA, 19 nt, synthetic construct
  source 1..19: mol_type = other RNA
ttgatgaaaacgggaagac

SEQ ID NO: 245 - RNA, 19 nt, synthetic construct
  source 1..19: mol_type = other RNA
atgaaaacgggaagacaaa

SEQ ID NO: 246 - RNA, 19 nt, synthetic construct
  source 1..19: mol_type = other RNA
tgaaaacgggaagacaaag

SEQ ID NO: 247 - RNA, 19 nt, synthetic construct
  source 1..19: mol_type = other RNA
aacgggaagacaaagacta

SEQ ID NO: 248 - RNA, 19 nt, synthetic construct
  source 1..19: mol_type = other RNA
cgggaagacaaagactacc

SEQ ID NO: 249 - RNA, 19 nt, synthetic construct
  source 1..19: mol_type = other RNA
gggaagacaaagactacct

SEQ ID NO: 250 - RNA, 19 nt, synthetic construct
  source 1..19: mol_type = other RNA
ttaaagtattactacatgc

SEQ ID NO: 251 - RNA, 19 nt, synthetic construct
  source 1..19: mol_type = other RNA
taaagtattactacatgcc

SEQ ID NO: 252 - RNA, 19 nt, synthetic construct
  source 1..19: mol_type = other RNA
gtattactacatgcccttt

SEQ ID NO: 253 - RNA, 19 nt, synthetic construct
  source 1..19: mol_type = other RNA
attactacatgccctttgg

SEQ ID NO: 254 - RNA, 19 nt, synthetic construct
  source 1..19: mol_type = other RNA
ttactacatgccctttgga

SEQ ID NO: 255 - RNA, 19 nt, synthetic construct
  source 1..19: mol_type = other RNA
actacatgccctttggatc

SEQ ID NO: 256 - RNA, 19 nt, synthetic construct
  source 1..19: mol_type = other RNA
ctacatgccctttggatcg

SEQ ID NO: 257 - RNA, 19 nt, synthetic construct
  source 1..19: mol_type = other RNA
gggagctacaatatgtcct

SEQ ID NO: 258 - RNA, 19 nt, synthetic construct
  source 1..19: mol_type = other RNA
gctacaatatgtcctggaa

SEQ ID NO: 259 - RNA, 19 nt, synthetic construct
  source 1..19: mol_type = other RNA
tacaatatgtcctggaaga

SEQ ID NO: 260 - RNA, 19 nt, synthetic construct
  source 1..19: mol_type = other RNA
acaatatgtcctggaagat

SEQ ID NO: 261 - RNA, 19 nt, synthetic construct
  source 1..19: mol_type = other RNA
gctatccacgaaatcaagc

SEQ ID NO: 262 - RNA, 19 nt, synthetic construct
  source 1..19: mol_type = other RNA
tatccacgaaatcaagcaa

SEQ ID NO: 263 - RNA, 19 nt, synthetic construct
  source 1..19: mol_type = other RNA
atccacgaaatcaagcaat

SEQ ID NO: 264 - RNA, 19 nt, synthetic construct
  source 1..19: mol_type = other RNA
tccacgaaatcaagcaatt

SEQ ID NO: 265 - RNA, 19 nt, synthetic construct
  source 1..19: mol_type = other RNA
aatcaagcaatttttgatt

SEQ ID NO: 266 - RNA, 19 nt, synthetic construct
  source 1..19: mol_type = other RNA
atcaagcaatttttgattc

SEQ ID NO: 267 - RNA, 19 nt, synthetic construct
  source 1..19: mol_type = other RNA
caatttttgattctgatgc

SEQ ID NO: 268 - RNA, 19 nt, synthetic construct
  source 1..19: mol_type = other RNA
atttttgattctgatgctt

SEQ ID NO: 269 - RNA, 19 nt, synthetic construct
  source 1..19: mol_type = other RNA
cagtcccgggcaggcttgg

SEQ ID NO: 270 - RNA, 19 nt, synthetic construct
  source 1..19: mol_type = other RNA
agtcccgggcaggcttggg

SEQ ID NO: 271 - RNA, 19 nt, synthetic construct
  source 1..19: mol_type = other RNA
cccgggcaggcttgggcat

SEQ ID NO: 272 - RNA, 19 nt, synthetic construct
  source 1..19: mol_type = other RNA
ccgggcaggcttgggcatt

SEQ ID NO: 273 - RNA, 19 nt, synthetic construct
  source 1..19: mol_type = other RNA
gggcaggcttgggcatttt

SEQ ID NO: 274 - RNA, 19 nt, synthetic construct
  source 1..19: mol_type = other RNA
ggcttgggcattttgccgc

SEQ ID NO: 275 - RNA, 19 nt, synthetic construct
  source 1..19: mol_type = other RNA
ttaaatataaattcaagca

SEQ ID NO: 276 - RNA, 19 nt, synthetic construct
  source 1..19: mol_type = other RNA
taaatataaattcaagcat

SEQ ID NO: 277 - RNA, 19 nt, synthetic construct
  source 1..19: mol_type = other RNA
aaatataaattcaagcatt

SEQ ID NO: 278 - RNA, 19 nt, synthetic construct
  source 1..19: mol_type = other RNA
aatataaattcaagcattt

SEQ ID NO: 279 - RNA, 19 nt, synthetic construct
  source 1..19: mol_type = other RNA
atataaattcaagcatttg

SEQ ID NO: 280 - RNA, 19 nt, synthetic construct
  source 1..19: mol_type = other RNA
ataaattcaagcatttgtg

SEQ ID NO: 281 - RNA, 19 nt, synthetic construct
  source 1..19: mol_type = other RNA
aataagaggacactagatg

SEQ ID NO: 282 - RNA, 19 nt, synthetic construct
  source 1..19: mol_type = other RNA
ataagaggacactagatga

SEQ ID NO: 283 - RNA, 19 nt, synthetic construct
  source 1..19: mol_type = other RNA
agaggacactagatgatat

SEQ ID NO: 284 - RNA, 19 nt, synthetic construct
  source 1..19: mol_type = other RNA
aggacactagatgatatta

SEQ ID NO: 285 - RNA, 19 nt, synthetic construct
  source 1..19: mol_type = other RNA
gacactagatgatattaca

SEQ ID NO: 286 - RNA, 19 nt, synthetic construct
  source 1..19: mol_type = other RNA
ctagatgatattacaggac

SEQ ID NO: 287 - RNA, 19 nt, synthetic construct
  source 1..19: mol_type = other RNA
tagatgatattacaggact

SEQ ID NO: 288 - RNA, 19 nt, synthetic construct
  source 1..19: mol_type = other RNA
atgatattacaggactgca

SEQ ID NO: 289 - RNA, 19 nt, synthetic construct
  source 1..19: mol_type = other RNA
tgatattacaggactgcag

SEQ ID NO: 290 - RNA, 19 nt, synthetic construct
  source 1..19: mol_type = other RNA
attacaggactgcagaaca

SEQ ID NO: 291 - RNA, 19 nt, synthetic construct
  source 1..19: mol_type = other RNA
accacacagtccctttgga

SEQ ID NO: 292 - RNA, 19 nt, synthetic construct
  source 1..19: mol_type = other RNA
atgcatttagtggtggtag

SEQ ID NO: 293 - RNA, 19 nt, synthetic construct
  source 1..19: mol_type = other RNA
tgcatttagtggtggtaga

SEQ ID NO: 294 - RNA, 19 nt, synthetic construct
  source 1..19: mol_type = other RNA
gcatttagtggtggtagaa

SEQ ID NO: 295 - RNA, 19 nt, synthetic construct
  source 1..19: mol_type = other RNA
catttagtggtggtagaaa

SEQ ID NO: 296 - RNA, 19 nt, synthetic construct
  source 1..19: mol_type = other RNA
gtggtggtagaaatgattc

SEQ ID NO: 297 - RNA, 19 nt, synthetic construct
  source 1..19: mol_type = other RNA
ggtggtagaaatgattcac

SEQ ID NO: 298 - RNA, 19 nt, synthetic construct
  source 1..19: mol_type = other RNA
tggtagaaatgattcacca

SEQ ID NO: 299 - RNA, 19 nt, synthetic construct
  source 1..19: mol_type = other RNA
tagaaatgattcaccaggt

SEQ ID NO: 300 - RNA, 19 nt, synthetic construct
  source 1..19: mol_type = other RNA
gattcaccaggtccaatgt

SEQ ID NO: 301 - RNA, 19 nt, synthetic construct
  source 1..19: mol_type = other RNA
tcaccaggtccaatgttgt

SEQ ID NO: 302 - RNA, 19 nt, synthetic construct
  source 1..19: mol_type = other RNA
ccaggtccaatgttgttca

SEQ ID NO: 303 - RNA, 19 nt, synthetic construct
  source 1..19: mol_type = other RNA
caggtccaatgttgttcac

SEQ ID NO: 304 - RNA, 19 nt, synthetic construct
  source 1..19: mol_type = other RNA
ggtccaatgttgttcacca

SEQ ID NO: 305 - RNA, 19 nt, synthetic construct
  source 1..19: mol_type = other RNA
tgcttgcttgtgaatctta

SEQ ID NO: 306 - RNA, 19 nt, synthetic construct
  source 1..19: mol_type = other RNA
gcttgcttgtgaatcttaa

SEQ ID NO: 307 - RNA, 19 nt, synthetic construct
  source 1..19: mol_type = other RNA
tgctagtgaaaagaactag

SEQ ID NO: 308 - RNA, 19 nt, synthetic construct
  source 1..19: mol_type = other RNA
gctagtgaaaagaactagt

SEQ ID NO: 309 - RNA, 19 nt, synthetic construct
  source 1..19: mol_type = other RNA
agtccatgaatgttcatat

SEQ ID NO: 310 - RNA, 19 nt, synthetic construct
  source 1..19: mol_type = other RNA
gtccatgaatgttcatata

SEQ ID NO: 311 - RNA, 19 nt, synthetic construct
  source 1..19: mol_type = other RNA
tccatgaatgttcatatag

SEQ ID NO: 312 - RNA, 19 nt, synthetic construct
  source 1..19: mol_type = other RNA
ccatgaatgttcatatagc

SEQ ID NO: 313 - RNA, 19 nt, synthetic construct
  source 1..19: mol_type = other RNA
catgaatgttcatatagcc

SEQ ID NO: 314 - RNA, 19 nt, synthetic construct
  source 1..19: mol_type = other RNA
atgaatgttcatatagcca

SEQ ID NO: 315 - RNA, 19 nt, synthetic construct
  source 1..19: mol_type = other RNA
tgaatgttcatatagccag

SEQ ID NO: 316 - RNA, 19 nt, synthetic construct
  source 1..19: mol_type = other RNA
tttttcaaaatgaagatac

SEQ ID NO: 317 - RNA, 19 nt, synthetic construct
  source 1..19: mol_type = other RNA
tattctaattggcagattg

SEQ ID NO: 318 - RNA, 19 nt, synthetic construct
  source 1..19: mol_type = other RNA
attctaattggcagattgt

SEQ ID NO: 319 - RNA, 19 nt, synthetic construct
  source 1..19: mol_type = other RNA
ttcctaaggaaactgcttt

SEQ ID NO: 320 - RNA, 19 nt, synthetic construct
  source 1..19: mol_type = other RNA
atgttcaaattcacgttct

SEQ ID NO: 321 - RNA, 19 nt, synthetic construct
  source 1..19: mol_type = other RNA
tgttcaaattcacgttcta

SEQ ID NO: 322 - RNA, 19 nt, synthetic construct
  source 1..19: mol_type = other RNA
caaattcacgttctagtga

SEQ ID NO: 323 - RNA, 19 nt, synthetic construct
  source 1..19: mol_type = other RNA
aaattcacgttctagtgaa

SEQ ID NO: 324 - RNA, 19 nt, synthetic construct
  source 1..19: mol_type = other RNA
aattcacgttctagtgaaa

SEQ ID NO: 325 - RNA, 19 nt, synthetic construct
  source 1..19: mol_type = other RNA
attcacgttctagtgaaac

SEQ ID NO: 326 - RNA, 19 nt, synthetic construct
  source 1..19: mol_type = other RNA
ttcacgttctagtgaaact

SEQ ID NO: 327 - RNA, 19 nt, synthetic construct
  source 1..19: mol_type = other RNA
tcacgttctagtgaaactg

SEQ ID NO: 328 - RNA, 19 nt, synthetic construct
  source 1..19: mol_type = other RNA
acgttctagtgaaactgca

SEQ ID NO: 329 - RNA, 19 nt, synthetic construct
  source 1..19: mol_type = other RNA
cgttctagtgaaactgcat

SEQ ID NO: 330 - RNA, 19 nt, synthetic construct
  source 1..19: mol_type = other RNA
ctagtgaaactgcattatt

SEQ ID NO: 331 - RNA, 19 nt, synthetic construct
  source 1..19: mol_type = other RNA
ggtgtgatcatatatcata

SEQ ID NO: 332 - RNA, 19 nt, synthetic construct
  source 1..19: mol_type = other RNA
gtgtgatcatatatcataa

SEQ ID NO: 333 - RNA, 19 nt, synthetic construct
  source 1..19: mol_type = other RNA
tgtgatcatatatcataaa

SEQ ID NO: 334 - RNA, 19 nt, synthetic construct
  source 1..19: mol_type = other RNA
gtgatcatatatcataaag

SEQ ID NO: 335 - RNA, 19 nt, synthetic construct
  source 1..19: mol_type = other RNA
tgatcatatatcataaagg

SEQ ID NO: 336 - RNA, 19 nt, synthetic construct
  source 1..19: mol_type = other RNA
gatcatatatcataaagga

SEQ ID NO: 337 - RNA, 19 nt, synthetic construct
  source 1..19: mol_type = other RNA
atcatatatcataaaggat

SEQ ID NO: 338 - RNA, 19 nt, synthetic construct
  source 1..19: mol_type = other RNA
tatatcataaaggatattt

SEQ ID NO: 339 - RNA, 19 nt, synthetic construct
  source 1..19: mol_type = other RNA
aggatatttcaaatgatta

SEQ ID NO: 340 - RNA, 19 nt, synthetic construct
  source 1..19: mol_type = other RNA
ggatatttcaaatgattat

SEQ ID NO: 341 - RNA, 19 nt, synthetic construct
  source 1..19: mol_type = other RNA
gatatttcaaatgattatg

SEQ ID NO: 342 - RNA, 19 nt, synthetic construct
  source 1..19: mol_type = other RNA
tttcaaatgattatgatta

SEQ ID NO: 343 - RNA, 19 nt, synthetic construct
  source 1..19: mol_type = other RNA
ttcaaatgattatgattag

SEQ ID NO: 344 - RNA, 19 nt, synthetic construct
  source 1..19: mol_type = other RNA
tcaaatgattatgattagt

SEQ ID NO: 345 - RNA, 19 nt, synthetic construct
  source 1..19: mol_type = other RNA
caaatgattatgattagtt

SEQ ID NO: 346 - RNA, 19 nt, synthetic construct
  source 1..19: mol_type = other RNA
aatgattatgattagttat

SEQ ID NO: 347 - RNA, 19 nt, synthetic construct
  source 1..19: mol_type = other RNA
atgattatgattagttatg

SEQ ID NO: 348 - RNA, 19 nt, synthetic construct
  source 1..19: mol_type = other RNA
gattatgattagttatgtc

SEQ ID NO: 349 - RNA, 19 nt, synthetic construct
  source 1..19: mol_type = other RNA
attatgattagttatgtct

SEQ ID NO: 350 - RNA, 19 nt, synthetic construct
  source 1..19: mol_type = other RNA
ttatgattagttatgtctt

SEQ ID NO: 351 - RNA, 19 nt, synthetic construct
  source 1..19: mol_type = other RNA
gatttcccaaaaacactaa

SEQ ID NO: 352 - RNA, 19 nt, synthetic construct
  source 1..19: mol_type = other RNA
ttcccaaaaacactaaagg

SEQ ID NO: 353 - RNA, 19 nt, synthetic construct
  source 1..19: mol_type = other RNA
tcccaaaaacactaaaggt

SEQ ID NO: 354 - RNA, 19 nt, synthetic construct
  source 1..19: mol_type = other RNA
ccaaaaacactaaaggtgg

SEQ ID NO: 355 - RNA, 19 nt, synthetic construct
  source 1..19: mol_type = other RNA
caaaaacactaaaggtggt

SEQ ID NO: 356 - RNA, 19 nt, synthetic construct
  source 1..19: mol_type = other RNA
aaaaacactaaaggtggtt

SEQ ID NO: 357 - RNA, 19 nt, synthetic construct
  source 1..19: mol_type = other RNA
atgttttaacttattgttg

SEQ ID NO: 358 - RNA, 19 nt, synthetic construct
  source 1..19: mol_type = other RNA
gttttaacttattgttgct

SEQ ID NO: 359 - RNA, 19 nt, synthetic construct
  source 1..19: mol_type = other RNA
ttttaacttattgttgctg

SEQ ID NO: 360 - RNA, 19 nt, synthetic construct
  source 1..19: mol_type = other RNA
cttattgttgctgaaaact

SEQ ID NO: 361 - RNA, 19 nt, synthetic construct
  source 1..19: mol_type = other RNA
tattgttgctgaaaactct

SEQ ID NO: 362 - RNA, 19 nt, synthetic construct
  source 1..19: mol_type = other RNA
attgttgctgaaaactcta

SEQ ID NO: 363 - RNA, 19 nt, synthetic construct
  source 1..19: mol_type = other RNA
ttgttgctgaaaactctat

SEQ ID NO: 364 - RNA, 19 nt, synthetic construct
  source 1..19: mol_type = other RNA
tgctgaaaactctatgtcc

SEQ ID NO: 365 - RNA, 19 nt, synthetic construct
  source 1..19: mol_type = other RNA
aaatgtagcttttatgtga

SEQ ID NO: 366 - RNA, 19 nt, synthetic construct
  source 1..19: mol_type = other RNA
aagctttggttatgaaaca

SEQ ID NO: 367 - RNA, 19 nt, synthetic construct
  source 1..19: mol_type = other RNA
agctttggttatgaaacat

SEQ ID NO: 368 - RNA, 19 nt, synthetic construct
  source 1..19: mol_type = other RNA
ttaaatgctttttatcgct

SEQ ID NO: 369 - RNA, 19 nt, synthetic construct
  source 1..19: mol_type = other RNA
taaatgctttttatcgcta

SEQ ID NO: 370 - RNA, 19 nt, synthetic construct
  source 1..19: mol_type = other RNA
aaatgctttttatcgctaa

SEQ ID NO: 371 - RNA, 19 nt, synthetic construct
  source 1..19: mol_type = other RNA
aatgctttttatcgctaaa

SEQ ID NO: 372 - RNA, 19 nt, synthetic construct
  source 1..19: mol_type = other RNA
atgctttttatcgctaaat

SEQ ID NO: 373 - RNA, 19 nt, synthetic construct
  source 1..19: mol_type = other RNA
tgctttttatcgctaaatg

SEQ ID NO: 374 - RNA, 19 nt, synthetic construct
  source 1..19: mol_type = other RNA
ttttatcgctaaatgactt

SEQ ID NO: 375 - RNA, 19 nt, synthetic construct
  source 1..19: mol_type = other RNA
tttatcgctaaatgacttg

SEQ ID NO: 376 - RNA, 19 nt, synthetic construct
  source 1..19: mol_type = other RNA
tatcgctaaatgacttgca

SEQ ID NO: 377 - RNA, 19 nt, synthetic construct
  source 1..19: mol_type = other RNA
atcgctaaatgacttgcag

SEQ ID NO: 378 - RNA, 19 nt, synthetic construct
  source 1..19: mol_type = other RNA
cgctaaatgacttgcagat

SEQ ID NO: 379 - RNA, 19 nt, synthetic construct
  source 1..19: mol_type = other RNA
aaatgacttgcagatgaaa

SEQ ID NO: 380 - RNA, 19 nt, synthetic construct
  source 1..19: mol_type = other RNA
tttaaatgctgtgtacaac

SEQ ID NO: 381 - RNA, 19 nt, synthetic construct
  source 1..19: mol_type = other RNA
aaatgctgtgtacaacaat

SEQ ID NO: 382 - RNA, 19 nt, synthetic construct
  source 1..19: mol_type = other RNA
aatgctgtgtacaacaatg

SEQ ID NO: 383 - RNA, 19 nt, synthetic construct
  source 1..19: mol_type = other RNA
ctgtgtacaacaatgcttt

SEQ ID NO: 384 - RNA, 19 nt, synthetic construct
  source 1..19: mol_type = other RNA
tgtacaacaatgctttgat

SEQ ID NO: 385 - RNA, 19 nt, synthetic construct
  source 1..19: mol_type = other RNA
gtacaacaatgctttgata

SEQ ID NO: 386 - RNA, 19 nt, synthetic construct
  source 1..19: mol_type = other RNA
tacaacaatgctttgataa

SEQ ID NO: 387 - RNA, 19 nt, synthetic construct
  source 1..19: mol_type = other RNA
taattttgaaatgattcat

SEQ ID NO: 388 - RNA, 19 nt, synthetic construct
  source 1..19: mol_type = other RNA
aattttgaaatgattcatc

SEQ ID NO: 389 - RNA, 19 nt, synthetic construct
  source 1..19: mol_type = other RNA
attttgaaatgattcatct

SEQ ID NO: 390 - RNA, 19 nt, synthetic construct
  source 1..19: mol_type = other RNA
ttgaaatgattcatctttc

SEQ ID NO: 391 - RNA, 19 nt, synthetic construct
  source 1..19: mol_type = other RNA
tgaaatgattcatctttca

SEQ ID NO: 392 - RNA, 19 nt, synthetic construct
  source 1..19: mol_type = other RNA
gaaataaaagtatgaatct

SEQ ID NO: 393 - RNA, 21 nt, synthetic construct
  source 1..21: mol_type = other RNA
ttcttcctcagagattttgga

SEQ ID NO: 394 - RNA, 21 nt, synthetic construct
  source 1..21: mol_type = other RNA
ctcagagattttggcctagaa

SEQ ID NO: 395 - RNA, 21 nt, synthetic construct
  source 1..21: mol_type = other RNA
tcagagattttggcctagata

SEQ ID NO: 396 - RNA, 21 nt, synthetic construct
  source 1..21: mol_type = other RNA
cagagattttggcctagatta

SEQ ID NO: 397 - RNA, 21 nt, synthetic construct
  source 1..21: mol_type = other RNA
agagattttggcctagattta

SEQ ID NO: 398 - RNA, 21 nt, synthetic construct
  source 1..21: mol_type = other RNA
agattttggcctagatttgca

SEQ ID NO: 399 - RNA, 21 nt, synthetic construct
  source 1..21: mol_type = other RNA
cagcatgctgttgtctatgga

SEQ ID NO: 400 - RNA, 21 nt, synthetic construct
  source 1..21: mol_type = other RNA
tgctgttgtctatggcttata

SEQ ID NO: 401 - RNA, 21 nt, synthetic construct
  source 1..21: mol_type = other RNA
gctgttgtctatggcttatta

SEQ ID NO: 402 - RNA, 21 nt, synthetic construct
  source 1..21: mol_type = other RNA
ctgttgtctatggcttattca

SEQ ID NO: 403 - RNA, 21 nt, synthetic construct
  source 1..21: mol_type = other RNA
tgttgtctatggcttattcta

SEQ ID NO: 404 - RNA, 21 nt, synthetic construct
  source 1..21: mol_type = other RNA
ttgtctatggcttattcttga

SEQ ID NO: 405 - RNA, 21 nt, synthetic construct
  source 1..21: mol_type = other RNA
tgtctatggcttattcttgga

SEQ ID NO: 406 - RNA, 21 nt, synthetic construct
  source 1..21: mol_type = other RNA
gtctatggcttattcttggaa

SEQ ID NO: 407 - RNA, 21 nt, synthetic construct
  source 1..21: mol_type = other RNA
tctatggcttattcttggaaa

SEQ ID NO: 408 - RNA, 21 nt, synthetic construct
  source 1..21: mol_type = other RNA
taggagaaggcaaacgggtga

SEQ ID NO: 409 - RNA, 21 nt, synthetic construct
  source 1..21: mol_type = other RNA
ggagaaggcaaacgggtgaaa

SEQ ID NO: 410 - RNA, 21 nt, synthetic construct
  source 1..21: mol_type = other RNA
gagaaggcaaacgggtgaaca

SEQ ID NO: 411 - RNA, 21 nt, synthetic construct
  source 1..21: mol_type = other RNA
agaaggcaaacgggtgaacca

SEQ ID NO: 412 - RNA, 21 nt, synthetic construct
  source 1..21: mol_type = other RNA
aattccatacctgggctgtga

SEQ ID NO: 413 - RNA, 21 nt, synthetic construct
  source 1..21: mol_type = other RNA
attccatacctgggctgtgca

SEQ ID NO: 414 - RNA, 21 nt, synthetic construct
  source 1..21: mol_type = other RNA
ttccatacctgggctgtgcta

SEQ ID NO: 415 - RNA, 21 nt, synthetic construct
  source 1..21: mol_type = other RNA
ctctgcaatttggtgccaata

SEQ ID NO: 416 - RNA, 21 nt, synthetic construct
  source 1..21: mol_type = other RNA
ctgcaatttggtgccaatcca

SEQ ID NO: 417 - RNA, 21 nt, synthetic construct
  source 1..21: mol_type = other RNA
ttggtgccaatcctcttgaga

SEQ ID NO: 418 - RNA, 21 nt, synthetic construct
  source 1..21: mol_type = other RNA
tgccaatcctcttgagttcca

SEQ ID NO: 419 - RNA, 21 nt, synthetic construct
  source 1..21: mol_type = other RNA
tcttgagttcctcagagcaaa

SEQ ID NO: 420 - RNA, 21 nt, synthetic construct
  source 1..21: mol_type = other RNA
ttgagttcctcagagcaaata

SEQ ID NO: 421 - RNA, 21 nt, synthetic construct
  source 1..21: mol_type = other RNA
gttcctcagagcaaatcaaaa

SEQ ID NO: 422 - RNA, 21 nt, synthetic construct
  source 1..21: mol_type = other RNA
ttcctcagagcaaatcaaaga

SEQ ID NO: 423 - RNA, 21 nt, synthetic construct
  source 1..21: mol_type = other RNA
agagcaaatcaaaggaaacaa

SEQ ID NO: 424 - RNA, 21 nt, synthetic construct
  source 1..21: mol_type = other RNA
agcaaatcaaaggaaacatga

SEQ ID NO: 425 - RNA, 21 nt, synthetic construct
  source 1..21: mol_type = other RNA
aatcaaaggaaacatggtcaa

SEQ ID NO: 426 - RNA, 21 nt, synthetic construct
  source 1..21: mol_type = other RNA
atcaaaggaaacatggtcata

SEQ ID NO: 427 - RNA, 21 nt, synthetic construct
  source 1..21: mol_type = other RNA
tcaaaggaaacatggtcatga

SEQ ID NO: 428 - RNA, 21 nt, synthetic construct
  source 1..21: mol_type = other RNA
caaaggaaacatggtcatgta

SEQ ID NO: 429 - RNA, 21 nt, synthetic construct
  source 1..21: mol_type = other RNA
aaaggaaacatggtcatgtta

SEQ ID NO: 430 - RNA, 21 nt, synthetic construct
  source 1..21: mol_type = other RNA
aaacatggtcatgtttttaca

SEQ ID NO: 431 - RNA, 21 nt, synthetic construct
  source 1..21: mol_type = other RNA
acatggtcatgtttttaccta

SEQ ID NO: 432 - RNA, 21 nt, synthetic construct
  source 1..21: mol_type = other RNA
catggtcatgtttttacctga

SEQ ID NO: 433 - RNA, 21 nt, synthetic construct
  source 1..21: mol_type = other RNA
tgtttttacctgcaaactaaa

SEQ ID NO: 434 - RNA, 21 nt, synthetic construct
  source 1..21: mol_type = other RNA
tttttacctgcaaactaatga

SEQ ID NO: 435 - RNA, 21 nt, synthetic construct
  source 1..21: mol_type = other RNA
tttacctgcaaactaatggga

SEQ ID NO: 436 - RNA, 21 nt, synthetic construct
  source 1..21: mol_type = other RNA
ttacctgcaaactaatgggaa

SEQ ID NO: 437 - RNA, 21 nt, synthetic construct
  source 1..21: mol_type = other RNA
tacctgcaaactaatgggaaa

SEQ ID NO: 438 - RNA, 21 nt, synthetic construct
  source 1..21: mol_type = other RNA
atgtccatttcatcacaaata

SEQ ID NO: 439 - RNA, 21 nt, synthetic construct
  source 1..21: mol_type = other RNA
tgtccatttcatcacaaatca

SEQ ID NO: 440 - RNA, 21 nt, synthetic construct
  source 1..21: mol_type = other RNA
tccatttcatcacaaatccca

SEQ ID NO: 441 - RNA, 21 nt, synthetic construct
  source 1..21: mol_type = other RNA
tcatcacaaatcccttgtcaa

SEQ ID NO: 442 - RNA, 21 nt, synthetic construct
  source 1..21: mol_type = other RNA
atcacaaatcccttgtcataa

SEQ ID NO: 443 - RNA, 21 nt, synthetic construct
  source 1..21: mol_type = other RNA
tcacaaatcccttgtcataca

SEQ ID NO: 444 - RNA, 21 nt, synthetic construct
  source 1..21: mol_type = other RNA
cacaaatcccttgtcatacca

SEQ ID NO: 445 - RNA, 21 nt, synthetic construct
  source 1..21: mol_type = other RNA
acaaatcccttgtcataccaa

SEQ ID NO: 446 - RNA, 21 nt, synthetic construct
  source 1..21: mol_type = other RNA
atcccttgtcataccataaga

SEQ ID NO: 447 - RNA, 21 nt, synthetic construct
  source 1..21: mol_type = other RNA
tcccttgtcataccataagga

SEQ ID NO: 448 - RNA, 21 nt, synthetic construct
  source 1..21: mol_type = other RNA
cccttgtcataccataaggta

SEQ ID NO: 449 - RNA, 21 nt, synthetic construct
  source 1..21: mol_type = other RNA
ccttgtcataccataaggtga

SEQ ID NO: 450 - RNA, 21 nt, synthetic construct
  source 1..21: mol_type = other RNA
cttgtcataccataaggtgta

SEQ ID NO: 451 - RNA, 21 nt, synthetic construct
  source 1..21: mol_type = other RNA
tgtcataccataaggtgttga

SEQ ID NO: 452 - RNA, 21 nt, synthetic construct
  source 1..21: mol_type = other RNA
ataccataaggtgttgtgcca

SEQ ID NO: 453 - RNA, 21 nt, synthetic construct
  source 1..21: mol_type = other RNA
aaaaatttcactttgctacta

SEQ ID NO: 454 - RNA, 21 nt, synthetic construct
  source 1..21: mol_type = other RNA
aatttcactttgctacttcta

SEQ ID NO: 455 - RNA, 21 nt, synthetic construct
  source 1..21: mol_type = other RNA
ttgctacttctgcgaaggcaa

SEQ ID NO: 456 - RNA, 21 nt, synthetic construct
  source 1..21: mol_type = other RNA
ctacttctgcgaaggcattta

SEQ ID NO: 457 - RNA, 21 nt, synthetic construct
  source 1..21: mol_type = other RNA
acttctgcgaaggcatttgga

SEQ ID NO: 458 - RNA, 21 nt, synthetic construct
  source 1..21: mol_type = other RNA
catttgggcacagaagcatta

SEQ ID NO: 459 - RNA, 21 nt, synthetic construct
  source 1..21: mol_type = other RNA
tttgggcacagaagcattgaa

SEQ ID NO: 460 - RNA, 21 nt, synthetic construct
  source 1..21: mol_type = other RNA
tgggcacagaagcattgacca

SEQ ID NO: 461 - RNA, 21 nt, synthetic construct
  source 1..21: mol_type = other RNA
atgccttgaattccctcacga

SEQ ID NO: 462 - RNA, 21 nt, synthetic construct
  source 1..21: mol_type = other RNA
tgccttgaattccctcacgga

SEQ ID NO: 463 - RNA, 21 nt, synthetic construct
  source 1..21: mol_type = other RNA
gccttgaattccctcacggaa

SEQ ID NO: 464 - RNA, 21 nt, synthetic construct
  source 1..21: mol_type = other RNA
ccttgaattccctcacggaaa

SEQ ID NO: 465 - RNA, 21 nt, synthetic construct
  source 1..21: mol_type = other RNA
cttgaattccctcacggaaaa

SEQ ID NO: 466 - RNA, 21 nt, synthetic construct
  source 1..21: mol_type = other RNA
aattccctcacggaaagcata

SEQ ID NO: 467 - RNA, 21 nt, synthetic construct
  source 1..21: mol_type = other RNA
ttccctcacggaaagcatgaa

SEQ ID NO: 468 - RNA, 21 nt, synthetic construct
  source 1..21: mol_type = other RNA
ccctcacggaaagcatgatga

SEQ ID NO: 469 - RNA, 21 nt, synthetic construct
  source 1..21: mol_type = other RNA
ctcacggaaagcatgatggaa

SEQ ID NO: 470 - RNA, 21 nt, synthetic construct
  source 1..21: mol_type = other RNA
tgatggaaaacctccaacgta

SEQ ID NO: 471 - RNA, 21 nt, synthetic construct
  source 1..21: mol_type = other RNA
atggaaaacctccaacgtata

SEQ ID NO: 472 - RNA, 21 nt, synthetic construct
  source 1..21: mol_type = other RNA
ggaaaacctccaacgtatcaa

SEQ ID NO: 473 - RNA, 21 nt, synthetic construct
  source 1..21: mol_type = other RNA
gaaaacctccaacgtatcata

SEQ ID NO: 474 - RNA, 21 nt, synthetic construct
  source 1..21: mol_type = other RNA
aaaacctccaacgtatcatga

SEQ ID NO: 475 - RNA, 21 nt, synthetic construct
  source 1..21: mol_type = other RNA
aacctccaacgtatcatgaga

SEQ ID NO: 476 - RNA, 21 nt, synthetic construct
  source 1..21: mol_type = other RNA
acctccaacgtatcatgagaa

SEQ ID NO: 477 - RNA, 21 nt, synthetic construct
  source 1..21: mol_type = other RNA
cctccaacgtatcatgagaca

SEQ ID NO: 478 - RNA, 21 nt, synthetic construct
  source 1..21: mol_type = other RNA
ctccaacgtatcatgagacca

SEQ ID NO: 479 - RNA, 21 nt, synthetic construct
  source 1..21: mol_type = other RNA
tccaacgtatcatgagaccta

SEQ ID NO: 480 - RNA, 21 nt, synthetic construct
  source 1..21: mol_type = other RNA
ccaacgtatcatgagacctca

SEQ ID NO: 481 - RNA, 21 nt, synthetic construct
  source 1..21: mol_type = other RNA
tcctctaactcaaagaccgca

SEQ ID NO: 482 - RNA, 21 nt, synthetic construct
  source 1..21: mol_type = other RNA
agaccgctgcctgggtgacaa

SEQ ID NO: 483 - RNA, 21 nt, synthetic construct
  source 1..21: mol_type = other RNA
ctgggtgacagaagggatgta

SEQ ID NO: 484 - RNA, 21 nt, synthetic construct
  source 1..21: mol_type = other RNA
tgggtgacagaagggatgtaa

SEQ ID NO: 485 - RNA, 21 nt, synthetic construct
  source 1..21: mol_type = other RNA
gggtgacagaagggatgtata

SEQ ID NO: 486 - RNA, 21 nt, synthetic construct
  source 1..21: mol_type = other RNA
ctttctgctaccgagtgatga

SEQ ID NO: 487 - RNA, 21 nt, synthetic construct
  source 1..21: mol_type = other RNA
ttctgctaccgagtgatgtta

SEQ ID NO: 488 - RNA, 21 nt, synthetic construct
  source 1..21: mol_type = other RNA
tctgctaccgagtgatgttta

SEQ ID NO: 489 - RNA, 21 nt, synthetic construct
  source 1..21: mol_type = other RNA
ctgctaccgagtgatgtttga

SEQ ID NO: 490 - RNA, 21 nt, synthetic construct
  source 1..21: mol_type = other RNA
taccgagtgatgtttgaagca

SEQ ID NO: 491 - RNA, 21 nt, synthetic construct
  source 1..21: mol_type = other RNA
accgagtgatgtttgaagcta

SEQ ID NO: 492 - RNA, 21 nt, synthetic construct
  source 1..21: mol_type = other RNA
ccgagtgatgtttgaagctga

SEQ ID NO: 493 - RNA, 21 nt, synthetic construct
  source 1..21: mol_type = other RNA
atgtttgaagctgggtattta

SEQ ID NO: 494 - RNA, 21 nt, synthetic construct
  source 1..21: mol_type = other RNA
tttgaagctgggtatttaaca

SEQ ID NO: 495 - RNA, 21 nt, synthetic construct
  source 1..21: mol_type = other RNA
ttgaagctgggtatttaacta

SEQ ID NO: 496 - RNA, 21 nt, synthetic construct
  source 1..21: mol_type = other RNA
tgaagctgggtatttaactaa

SEQ ID NO: 497 - RNA, 21 nt, synthetic construct
  source 1..21: mol_type = other RNA
gaagctgggtatttaactata

SEQ ID NO: 498 - RNA, 21 nt, synthetic construct
  source 1..21: mol_type = other RNA
aagctgggtatttaactatca

SEQ ID NO: 499 - RNA, 21 nt, synthetic construct
  source 1..21: mol_type = other RNA
agctgggtatttaactatcta

SEQ ID NO: 500 - RNA, 21 nt, synthetic construct
  source 1..21: mol_type = other RNA
ctgggtatttaactatcttta

SEQ ID NO: 501 - RNA, 21 nt, synthetic construct
  source 1..21: mol_type = other RNA
tgggtatttaactatctttga

SEQ ID NO: 502 - RNA, 21 nt, synthetic construct
  source 1..21: mol_type = other RNA
gacacacagaaagcacatata

SEQ ID NO: 503 - RNA, 21 nt, synthetic construct
  source 1..21: mol_type = other RNA
aagcacatattctaaacaata

SEQ ID NO: 504 - RNA, 21 nt, synthetic construct
  source 1..21: mol_type = other RNA
gcacatattctaaacaatcta

SEQ ID NO: 505 - RNA, 21 nt, synthetic construct
  source 1..21: mol_type = other RNA
cacatattctaaacaatctta

SEQ ID NO: 506 - RNA, 21 nt, synthetic construct
  source 1..21: mol_type = other RNA
acatattctaaacaatcttga

SEQ ID NO: 507 - RNA, 21 nt, synthetic construct
  source 1..21: mol_type = other RNA
atattctaaacaatcttgaca

SEQ ID NO: 508 - RNA, 21 nt, synthetic construct
  source 1..21: mol_type = other RNA
tattctaaacaatcttgacaa

SEQ ID NO: 509 - RNA, 21 nt, synthetic construct
  source 1..21: mol_type = other RNA
attctaaacaatcttgacaaa

SEQ ID NO: 510 - RNA, 21 nt, synthetic construct
  source 1..21: mol_type = other RNA
tctaaacaatcttgacaacta

SEQ ID NO: 511 - RNA, 21 nt, synthetic construct
  source 1..21: mol_type = other RNA
caatcttgacaacttcaagca

SEQ ID NO: 512 - RNA, 21 nt, synthetic construct
  source 1..21: mol_type = other RNA
ctttccagccctggtagcaga

SEQ ID NO: 513 - RNA, 21 nt, synthetic construct
  source 1..21: mol_type = other RNA
gggagaaactggcagagagca

SEQ ID NO: 514 - RNA, 21 nt, synthetic construct
  source 1..21: mol_type = other RNA
ggcagagagcttgaggcacga

SEQ ID NO: 515 - RNA, 21 nt, synthetic construct
  source 1..21: mol_type = other RNA
agcttgaggcacgagaaccta

SEQ ID NO: 516 - RNA, 21 nt, synthetic construct
  source 1..21: mol_type = other RNA
cctgcgcatgtttctcaatga

SEQ ID NO: 517 - RNA, 21 nt, synthetic construct
  source 1..21: mol_type = other RNA
gcgcatgtttctcaatgacaa

SEQ ID NO: 518 - RNA, 21 nt, synthetic construct
  source 1..21: mol_type = other RNA
gcatgtttctcaatgacacta

SEQ ID NO: 519 - RNA, 21 nt, synthetic construct
  source 1..21: mol_type = other RNA
gtttctcaatgacactttgta

SEQ ID NO: 520 - RNA, 21 nt, synthetic construct
  source 1..21: mol_type = other RNA
tttctcaatgacactttgtca

SEQ ID NO: 521 - RNA, 21 nt, synthetic construct
  source 1..21: mol_type = other RNA
ttctcaatgacactttgtcca

SEQ ID NO: 522 - RNA, 21 nt, synthetic construct
  source 1..21: mol_type = other RNA
acactttgtccacctttgata

SEQ ID NO: 523 - RNA, 21 nt, synthetic construct
  source 1..21: mol_type = other RNA
cactttgtccacctttgatga

SEQ ID NO: 524 - RNA, 21 nt, synthetic construct
  source 1..21: mol_type = other RNA
acacctcgtggtcctctggga

SEQ ID NO: 525 - RNA, 21 nt, synthetic construct
  source 1..21: mol_type = other RNA
acctcgtggtcctctgggcaa

SEQ ID NO: 526 - RNA, 21 nt, synthetic construct
  source 1..21: mol_type = other RNA
cctcgtggtcctctgggcata

SEQ ID NO: 527 - RNA, 21 nt, synthetic construct
  source 1..21: mol_type = other RNA
ctcgtggtcctctgggcatca

SEQ ID NO: 528 - RNA, 21 nt, synthetic construct
  source 1..21: mol_type = other RNA
tcgtggtcctctgggcatcga

SEQ ID NO: 529 - RNA, 21 nt, synthetic construct
  source 1..21: mol_type = other RNA
tcctctgggcatcgcaagcaa

SEQ ID NO: 530 - RNA, 21 nt, synthetic construct
  source 1..21: mol_type = other RNA
tctgggcatcgcaagcaaaca

SEQ ID NO: 531 - RNA, 21 nt, synthetic construct
  source 1..21: mol_type = other RNA
ctgggcatcgcaagcaaacaa

SEQ ID NO: 532 - RNA, 21 nt, synthetic construct
  source 1..21: mol_type = other RNA
tgggcatcgcaagcaaacaca

SEQ ID NO: 533 - RNA, 21 nt, synthetic construct
  source 1..21: mol_type = other RNA
gcatcgcaagcaaacaccata

SEQ ID NO: 534 - RNA, 21 nt, synthetic construct
  source 1..21: mol_type = other RNA
catcgcaagcaaacaccatta

SEQ ID NO: 535 - RNA, 21 nt, synthetic construct
  source 1..21: mol_type = other RNA
ttctggagtttatttcaaata

SEQ ID NO: 536 - RNA, 21 nt, synthetic construct
  source 1..21: mol_type = other RNA
ggagtttatttcaaatgatta

SEQ ID NO: 537 - RNA, 21 nt, synthetic construct
  source 1..21: mol_type = other RNA
gagtttatttcaaatgattaa

SEQ ID NO: 538 - RNA, 21 nt, synthetic construct
  source 1..21: mol_type = other RNA
agtttatttcaaatgattaga

SEQ ID NO: 539 - RNA, 21 nt, synthetic construct
  source 1..21: mol_type = other RNA
gtttatttcaaatgattagga

SEQ ID NO: 540 - RNA, 21 nt, synthetic construct
  source 1..21: mol_type = other RNA
ccagaagcaatgaaagcagca

SEQ ID NO: 541 - RNA, 21 nt, synthetic construct
  source 1..21: mol_type = other RNA
agaagcaatgaaagcagctaa

SEQ ID NO: 542 - RNA, 21 nt, synthetic construct
  source 1..21: mol_type = other RNA
gaagcaatgaaagcagctaca

SEQ ID NO: 543 - RNA, 21 nt, synthetic construct
  source 1..21: mol_type = other RNA
aatgaaagcagctactgaaga

SEQ ID NO: 544 - RNA, 21 nt, synthetic construct
  source 1..21: mol_type = other RNA
atgaaagcagctactgaagaa

SEQ ID NO: 545 - RNA, 21 nt, synthetic construct
  source 1..21: mol_type = other RNA
aaagcagctactgaagaagta

SEQ ID NO: 546 - RNA, 21 nt, synthetic construct
  source 1..21: mol_type = other RNA
aagcagctactgaagaagtga

SEQ ID NO: 547 - RNA, 21 nt, synthetic construct
  source 1..21: mol_type = other RNA
agcagctactgaagaagtgaa

SEQ ID NO: 548 - RNA, 21 nt, synthetic construct
  source 1..21: mol_type = other RNA
gcagctactgaagaagtgaaa

SEQ ID NO: 549 - RNA, 21 nt, synthetic construct
  source 1..21: mol_type = other RNA
cagctactgaagaagtgaaaa

SEQ ID NO: 550 - RNA, 21 nt, synthetic construct
  source 1..21: mol_type = other RNA
aagaagtgaaaagaacattaa

SEQ ID NO: 551 - RNA, 21 nt, synthetic construct
  source 1..21: mol_type = other RNA
agaagtgaaaagaacattaga

SEQ ID NO: 552 - RNA, 21 nt, synthetic construct
  source 1..21: mol_type = other RNA
gaagtgaaaagaacattagaa

SEQ ID NO: 553 - RNA, 21 nt, synthetic construct
  source 1..21: mol_type = other RNA
tgaaaagaacattagagaata

SEQ ID NO: 554 - RNA, 21 nt, synthetic construct
  source 1..21: mol_type = other RNA
gaaaagaacattagagaatga

SEQ ID NO: 555 - RNA, 21 nt, synthetic construct
  source 1..21: mol_type = other RNA
aaaagaacattagagaatgca

SEQ ID NO: 556 - RNA, 21 nt, synthetic construct
  source 1..21: mol_type = other RNA
aacattagagaatgctggtca

SEQ ID NO: 557 - RNA, 21 nt, synthetic construct
  source 1..21: mol_type = other RNA
acattagagaatgctggtcaa

SEQ ID NO: 558 - RNA, 21 nt, synthetic construct
  source 1..21: mol_type = other RNA
cattagagaatgctggtcaaa

SEQ ID NO: 559 - RNA, 21 nt, synthetic construct
  source 1..21: mol_type = other RNA
attagagaatgctggtcaaaa

SEQ ID NO: 560 - RNA, 21 nt, synthetic construct
  source 1..21: mol_type = other RNA
agaatgctggtcaaaaagtca

SEQ ID NO: 561 - RNA, 21 nt, synthetic construct
  source 1..21: mol_type = other RNA
gaatgctggtcaaaaagtcaa

SEQ ID NO: 562 - RNA, 21 nt, synthetic construct
  source 1..21: mol_type = other RNA
atgctggtcaaaaagtcagca

SEQ ID NO: 563 - RNA, 21 nt, synthetic construct
  source 1..21: mol_type = other RNA
tcaaaaagtcagcttggaaga

SEQ ID NO: 564 - RNA, 21 nt, synthetic construct
  source 1..21: mol_type = other RNA
aaaagtcagcttggaaggcaa

SEQ ID NO: 565 - RNA, 21 nt, synthetic construct
  source 1..21: mol_type = other RNA
agtcagcttggaaggcaatca

SEQ ID NO: 566 - RNA, 21 nt, synthetic construct
  source 1..21: mol_type = other RNA
actgaatgacctgccagtata

SEQ ID NO: 567 - RNA, 21 nt, synthetic construct
  source 1..21: mol_type = other RNA
gaatgacctgccagtattaga

SEQ ID NO: 568 - RNA, 21 nt, synthetic construct
  source 1..21: mol_type = other RNA
tttccagtgcctccctcaaca

SEQ ID NO: 569 - RNA, 21 nt, synthetic construct
  source 1..21: mol_type = other RNA
aacatccggacagctaaggaa

SEQ ID NO: 570 - RNA, 21 nt, synthetic construct
  source 1..21: mol_type = other RNA
acatccggacagctaaggaga

SEQ ID NO: 571 - RNA, 21 nt, synthetic construct
  source 1..21: mol_type = other RNA
tccggacagctaaggaggata

SEQ ID NO: 572 - RNA, 21 nt, synthetic construct
  source 1..21: mol_type = other RNA
ggacagctaaggaggatttca

SEQ ID NO: 573 - RNA, 21 nt, synthetic construct
  source 1..21: mol_type = other RNA
acagctaaggaggatttcaca

SEQ ID NO: 574 - RNA, 21 nt, synthetic construct
  source 1..21: mol_type = other RNA
agctaaggaggatttcactta

SEQ ID NO: 575 - RNA, 21 nt, synthetic construct
  source 1..21: mol_type = other RNA
taaggaggatttcactttgca

SEQ ID NO: 576 - RNA, 21 nt, synthetic construct
  source 1..21: mol_type = other RNA
ggaggatttcactttgcacca

SEQ ID NO: 577 - RNA, 21 nt, synthetic construct
  source 1..21: mol_type = other RNA
gaggatttcactttgcaccta

SEQ ID NO: 578 - RNA, 21 nt, synthetic construct
  source 1..21: mol_type = other RNA
tttcactttgcaccttgagga

SEQ ID NO: 579 - RNA, 21 nt, synthetic construct
  source 1..21: mol_type = other RNA
cactttgcaccttgaggacga

SEQ ID NO: 580 - RNA, 21 nt, synthetic construct
  source 1..21: mol_type = other RNA
actttgcaccttgaggacgga

SEQ ID NO: 581 - RNA, 21 nt, synthetic construct
  source 1..21: mol_type = other RNA
tgaggacggttcctacaacaa

SEQ ID NO: 582 - RNA, 21 nt, synthetic construct
  source 1..21: mol_type = other RNA
aggacggttcctacaacatca

SEQ ID NO: 583 - RNA, 21 nt, synthetic construct
  source 1..21: mol_type = other RNA
acggttcctacaacatccgaa

SEQ ID NO: 584 - RNA, 21 nt, synthetic construct
  source 1..21: mol_type = other RNA
ggttcctacaacatccgaaaa

SEQ ID NO: 585 - RNA, 21 nt, synthetic construct
  source 1..21: mol_type = other RNA
cctacaacatccgaaaagata

SEQ ID NO: 586 - RNA, 21 nt, synthetic construct
  source 1..21: mol_type = other RNA
ctacaacatccgaaaagatga

SEQ ID NO: 587 - RNA, 21 nt, synthetic construct
  source 1..21: mol_type = other RNA
acaacatccgaaaagatgaca

SEQ ID NO: 588 - RNA, 21 nt, synthetic construct
  source 1..21: mol_type = other RNA
caacatccgaaaagatgacaa

SEQ ID NO: 589 - RNA, 21 nt, synthetic construct
  source 1..21: mol_type = other RNA
aacatccgaaaagatgacata

SEQ ID NO: 590 - RNA, 21 nt, synthetic construct
  source 1..21: mol_type = other RNA
catccgaaaagatgacatcaa

SEQ ID NO: 591 - RNA, 21 nt, synthetic construct
  source 1..21: mol_type = other RNA
tccgaaaagatgacatcataa

SEQ ID NO: 592 - RNA, 21 nt, synthetic construct
  source 1..21: mol_type = other RNA
gaaaagatgacatcatagcta

SEQ ID NO: 593 - RNA, 21 nt, synthetic construct
  source 1..21: mol_type = other RNA
aaagatgacatcatagctcta

SEQ ID NO: 594 - RNA, 21 nt, synthetic construct
  source 1..21: mol_type = other RNA
aagatgacatcatagctctta

SEQ ID NO: 595 - RNA, 21 nt, synthetic construct
  source 1..21: mol_type = other RNA
gatgacatcatagctctttaa

SEQ ID NO: 596 - RNA, 21 nt, synthetic construct
  source 1..21: mol_type = other RNA
atagctctttacccacagtta

SEQ ID NO: 597 - RNA, 21 nt, synthetic construct
  source 1..21: mol_type = other RNA
tagctctttacccacagttaa

SEQ ID NO: 598 - RNA, 21 nt, synthetic construct
  source 1..21: mol_type = other RNA
agctctttacccacagttaaa

SEQ ID NO: 599 - RNA, 21 nt, synthetic construct
  source 1..21: mol_type = other RNA
gctctttacccacagttaata

SEQ ID NO: 600 - RNA, 21 nt, synthetic construct
  source 1..21: mol_type = other RNA
ctctttacccacagttaatga

SEQ ID NO: 601 - RNA, 21 nt, synthetic construct
  source 1..21: mol_type = other RNA
tctttacccacagttaatgca

SEQ ID NO: 602 - RNA, 21 nt, synthetic construct
  source 1..21: mol_type = other RNA
tttacccacagttaatgcaca

SEQ ID NO: 603 - RNA, 21 nt, synthetic construct
  source 1..21: mol_type = other RNA
acccacagttaatgcacttaa

SEQ ID NO: 604 - RNA, 21 nt, synthetic construct
  source 1..21: mol_type = other RNA
cccacagttaatgcacttaga

SEQ ID NO: 605 - RNA, 21 nt, synthetic construct
  source 1..21: mol_type = other RNA
ccacagttaatgcacttagaa

SEQ ID NO: 606 - RNA, 21 nt, synthetic construct
  source 1..21: mol_type = other RNA
cacagttaatgcacttagata

SEQ ID NO: 607 - RNA, 21 nt, synthetic construct
  source 1..21: mol_type = other RNA
acagttaatgcacttagatca

SEQ ID NO: 608 - RNA, 21 nt, synthetic construct
  source 1..21: mol_type = other RNA
cagttaatgcacttagatcca

SEQ ID NO: 609 - RNA, 21 nt, synthetic construct
  source 1..21: mol_type = other RNA
agttaatgcacttagatccaa

SEQ ID NO: 610 - RNA, 21 nt, synthetic construct
  source 1..21: mol_type = other RNA
tgcacttagatccagaaatca

SEQ ID NO: 611 - RNA, 21 nt, synthetic construct
  source 1..21: mol_type = other RNA
gcacttagatccagaaatcta

SEQ ID NO: 612 - RNA, 21 nt, synthetic construct
  source 1..21: mol_type = other RNA
agaaatctacccagaccctta

SEQ ID NO: 613 - RNA, 21 nt, synthetic construct
  source 1..21: mol_type = other RNA
acttttaaatatgataggtaa

SEQ ID NO: 614 - RNA, 21 nt, synthetic construct
  source 1..21: mol_type = other RNA
ttttaaatatgataggtatca

SEQ ID NO: 615 - RNA, 21 nt, synthetic construct
  source 1..21: mol_type = other RNA
tttaaatatgataggtatcta

SEQ ID NO: 616 - RNA, 21 nt, synthetic construct
  source 1..21: mol_type = other RNA
taaatatgataggtatcttga

SEQ ID NO: 617 - RNA, 21 nt, synthetic construct
  source 1..21: mol_type = other RNA
aatatgataggtatcttgata

SEQ ID NO: 618 - RNA, 21 nt, synthetic construct
  source 1..21: mol_type = other RNA
atatgataggtatcttgatga

SEQ ID NO: 619 - RNA, 21 nt, synthetic construct
  source 1..21: mol_type = other RNA
tatgataggtatcttgatgaa

SEQ ID NO: 620 - RNA, 21 nt, synthetic construct
  source 1..21: mol_type = other RNA
atgataggtatcttgatgaaa

SEQ ID NO: 621 - RNA, 21 nt, synthetic construct
  source 1..21: mol_type = other RNA
ataggtatcttgatgaaaaca

SEQ ID NO: 622 - RNA, 21 nt, synthetic construct
  source 1..21: mol_type = other RNA
taggtatcttgatgaaaacga

SEQ ID NO: 623 - RNA, 21 nt, synthetic construct
  source 1..21: mol_type = other RNA
aggtatcttgatgaaaacgga

SEQ ID NO: 624 - RNA, 21 nt, synthetic construct
  source 1..21: mol_type = other RNA
ggtatcttgatgaaaacggga

SEQ ID NO: 625 - RNA, 21 nt, synthetic construct
  source 1..21: mol_type = other RNA
gtatcttgatgaaaacgggaa

SEQ ID NO: 626 - RNA, 21 nt, synthetic construct
  source 1..21: mol_type = other RNA
tatcttgatgaaaacgggaaa

SEQ ID NO: 627 - RNA, 21 nt, synthetic construct
  source 1..21: mol_type = other RNA
atcttgatgaaaacgggaaga

SEQ ID NO: 628 - RNA, 21 nt, synthetic construct
  source 1..21: mol_type = other RNA
tcttgatgaaaacgggaagaa

SEQ ID NO: 629 - RNA, 21 nt, synthetic construct
  source 1..21: mol_type = other RNA
tgatgaaaacgggaagacaaa

SEQ ID NO: 630 - RNA, 21 nt, synthetic construct
  source 1..21: mol_type = other RNA
gatgaaaacgggaagacaaaa

SEQ ID NO: 631 - RNA, 21 nt, synthetic construct
  source 1..21: mol_type = other RNA
aaaacgggaagacaaagacta

SEQ ID NO: 632 - RNA, 21 nt, synthetic construct
  source 1..21: mol_type = other RNA
aacgggaagacaaagactaca

SEQ ID NO: 633 - RNA, 21 nt, synthetic construct
  source 1..21: mol_type = other RNA
acgggaagacaaagactacca

SEQ ID NO: 634 - RNA, 21 nt, synthetic construct
  source 1..21: mol_type = other RNA
agttaaagtattactacatga

SEQ ID NO: 635 - RNA, 21 nt, synthetic construct
  source 1..21: mol_type = other RNA
gttaaagtattactacatgca

SEQ ID NO: 636 - RNA, 21 nt, synthetic construct
  source 1..21: mol_type = other RNA
aagtattactacatgccctta

SEQ ID NO: 637 - RNA, 21 nt, synthetic construct
  source 1..21: mol_type = other RNA
gtattactacatgccctttga

SEQ ID NO: 638 - RNA, 21 nt, synthetic construct
  source 1..21: mol_type = other RNA
tattactacatgccctttgga

SEQ ID NO: 639 - RNA, 21 nt, synthetic construct
  source 1..21: mol_type = other RNA
ttactacatgccctttggata

SEQ ID NO: 640 - RNA, 21 nt, synthetic construct
  source 1..21: mol_type = other RNA
tactacatgccctttggatca

SEQ ID NO: 641 - RNA, 21 nt, synthetic construct
  source 1..21: mol_type = other RNA
tcgggagctacaatatgtcca

SEQ ID NO: 642 - RNA, 21 nt, synthetic construct
  source 1..21: mol_type = other RNA
gagctacaatatgtcctggaa

SEQ ID NO: 643 - RNA, 21 nt, synthetic construct
  source 1..21: mol_type = other RNA
gctacaatatgtcctggaaga

SEQ ID NO: 644 - RNA, 21 nt, synthetic construct
  source 1..21: mol_type = other RNA
ctacaatatgtcctggaagaa

SEQ ID NO: 645 - RNA, 21 nt, synthetic construct
  source 1..21: mol_type = other RNA
tcgctatccacgaaatcaaga

SEQ ID NO: 646 - RNA, 21 nt, synthetic construct
  source 1..21: mol_type = other RNA
gctatccacgaaatcaagcaa

SEQ ID NO: 647 - RNA, 21 nt, synthetic construct
  source 1..21: mol_type = other RNA
ctatccacgaaatcaagcaaa

SEQ ID NO: 648 - RNA, 21 nt, synthetic construct
  source 1..21: mol_type = other RNA
tatccacgaaatcaagcaata

SEQ ID NO: 649 - RNA, 21 nt, synthetic construct
  source 1..21: mol_type = other RNA
gaaatcaagcaatttttgata

SEQ ID NO: 650 - RNA, 21 nt, synthetic construct
  source 1..21: mol_type = other RNA
aaatcaagcaatttttgatta

SEQ ID NO: 651 - RNA, 21 nt, synthetic construct
  source 1..21: mol_type = other RNA
agcaatttttgattctgatga

SEQ ID NO: 652 - RNA, 21 nt, synthetic construct
  source 1..21: mol_type = other RNA
caatttttgattctgatgcta

SEQ ID NO: 653 - RNA, 21 nt, synthetic construct
  source 1..21: mol_type = other RNA
accagtcccgggcaggcttga

SEQ ID NO: 654 - RNA, 21 nt, synthetic construct
  source 1..21: mol_type = other RNA
ccagtcccgggcaggcttgga

SEQ ID NO: 655 - RNA, 21 nt, synthetic construct
  source 1..21: mol_type = other RNA
gtcccgggcaggcttgggcaa

SEQ ID NO: 656 - RNA, 21 nt, synthetic construct
  source 1..21: mol_type = other RNA
tcccgggcaggcttgggcata

SEQ ID NO: 657 - RNA, 21 nt, synthetic construct
  source 1..21: mol_type = other RNA
ccgggcaggcttgggcattta

SEQ ID NO: 658 - RNA, 21 nt, synthetic construct
  source 1..21: mol_type = other RNA
caggcttgggcattttgccga

SEQ ID NO: 659 - RNA, 21 nt, synthetic construct
  source 1..21: mol_type = other RNA
atttaaatataaattcaagca

SEQ ID NO: 660 - RNA, 21 nt, synthetic construct
  source 1..21: mol_type = other RNA
tttaaatataaattcaagcaa

SEQ ID NO: 661 - RNA, 21 nt, synthetic construct
  source 1..21: mol_type = other RNA
ttaaatataaattcaagcata

SEQ ID NO: 662 - RNA, 21 nt, synthetic construct
  source 1..21: mol_type = other RNA
taaatataaattcaagcatta

SEQ ID NO: 663 - RNA, 21 nt, synthetic construct
  source 1..21: mol_type = other RNA
aaatataaattcaagcattta

SEQ ID NO: 664 - RNA, 21 nt, synthetic construct
  source 1..21: mol_type = other RNA
atataaattcaagcatttgta

SEQ ID NO: 665 - RNA, 21 nt, synthetic construct
  source 1..21: mol_type = other RNA
ggaataagaggacactagata

SEQ ID NO: 666 - RNA, 21 nt, synthetic construct
  source 1..21: mol_type = other RNA
gaataagaggacactagatga

SEQ ID NO: 667 - RNA, 21 nt, synthetic construct
  source 1..21: mol_type = other RNA
taagaggacactagatgataa

SEQ ID NO: 668 - RNA, 21 nt, synthetic construct
  source 1..21: mol_type = other RNA
agaggacactagatgatatta

SEQ ID NO: 669 - RNA, 21 nt, synthetic construct
  source 1..21: mol_type = other RNA
aggacactagatgatattaca

SEQ ID NO: 670 - RNA, 21 nt, synthetic construct
  source 1..21: mol_type = other RNA
cactagatgatattacaggaa

SEQ ID NO: 671 - RNA, 21 nt, synthetic construct
  source 1..21: mol_type = other RNA
actagatgatattacaggaca

SEQ ID NO: 672 - RNA, 21 nt, synthetic construct
  source 1..21: mol_type = other RNA
agatgatattacaggactgca

SEQ ID NO: 673 - RNA, 21 nt, synthetic construct
  source 1..21: mol_type = other RNA
gatgatattacaggactgcaa

SEQ ID NO: 674 - RNA, 21 nt, synthetic construct
  source 1..21: mol_type = other RNA
atattacaggactgcagaaca

SEQ ID NO: 675 - RNA, 21 nt, synthetic construct
  source 1..21: mol_type = other RNA
tcaccacacagtccctttgga

SEQ ID NO: 676 - RNA, 21 nt, synthetic construct
  source 1..21: mol_type = other RNA
aaatgcatttagtggtggtaa

SEQ ID NO: 677 - RNA, 21 nt, synthetic construct
  source 1..21: mol_type = other RNA
aatgcatttagtggtggtaga

SEQ ID NO: 678 - RNA, 21 nt, synthetic construct
  source 1..21: mol_type = other RNA
atgcatttagtggtggtagaa

SEQ ID NO: 679 - RNA, 21 nt, synthetic construct
  source 1..21: mol_type = other RNA
tgcatttagtggtggtagaaa

SEQ ID NO: 680 - RNA, 21 nt, synthetic construct
  source 1..21: mol_type = other RNA
tagtggtggtagaaatgatta

SEQ ID NO: 681 - RNA, 21 nt, synthetic construct
  source 1..21: mol_type = other RNA
gtggtggtagaaatgattcaa

SEQ ID NO: 682 - RNA, 21 nt, synthetic construct
  source 1..21: mol_type = other RNA
ggtggtagaaatgattcacca

SEQ ID NO: 683 - RNA, 21 nt, synthetic construct
  source 1..21: mol_type = other RNA
ggtagaaatgattcaccagga

SEQ ID NO: 684 - RNA, 21 nt, synthetic construct
  source 1..21: mol_type = other RNA
atgattcaccaggtccaatga

SEQ ID NO: 685 - RNA, 21 nt, synthetic construct
  source 1..21: mol_type = other RNA
attcaccaggtccaatgttga

SEQ ID NO: 686 - RNA, 21 nt, synthetic construct
  source 1..21: mol_type = other RNA
caccaggtccaatgttgttca

SEQ ID NO: 687 - RNA, 21 nt, synthetic construct
  source 1..21: mol_type = other RNA
accaggtccaatgttgttcaa

SEQ ID NO: 688 - RNA, 21 nt, synthetic construct
  source 1..21: mol_type = other RNA
caggtccaatgttgttcacca

SEQ ID NO: 689 - RNA, 21 nt, synthetic construct
  source 1..21: mol_type = other RNA
agtgcttgcttgtgaatctta

SEQ ID NO: 690 - RNA, 21 nt, synthetic construct
  source 1..21: mol_type = other RNA
gtgcttgcttgtgaatcttaa

SEQ ID NO: 691 - RNA, 21 nt, synthetic construct
  source 1..21: mol_type = other RNA
tctgctagtgaaaagaactaa

SEQ ID NO: 692 - RNA, 21 nt, synthetic construct
  source 1..21: mol_type = other RNA
ctgctagtgaaaagaactaga

SEQ ID NO: 693 - RNA, 21 nt, synthetic construct
  source 1..21: mol_type = other RNA
taagtccatgaatgttcataa

SEQ ID NO: 694 - RNA, 21 nt, synthetic construct
  source 1..21: mol_type = other RNA
aagtccatgaatgttcatata

SEQ ID NO: 695 - RNA, 21 nt, synthetic construct
  source 1..21: mol_type = other RNA
agtccatgaatgttcatataa

SEQ ID NO: 696 - RNA, 21 nt, synthetic construct
  source 1..21: mol_type = other RNA
gtccatgaatgttcatataga

SEQ ID NO: 697 - RNA, 21 nt, synthetic construct
  source 1..21: mol_type = other RNA
tccatgaatgttcatatagca

SEQ ID NO: 698 - RNA, 21 nt, synthetic construct
  source 1..21: mol_type = other RNA
ccatgaatgttcatatagcca

SEQ ID NO: 699 - RNA, 21 nt, synthetic construct
  source 1..21: mol_type = other RNA
catgaatgttcatatagccaa

SEQ ID NO: 700 - RNA, 21 nt, synthetic construct
  source 1..21: mol_type = other RNA
tttttttcaaaatgaagataa

SEQ ID NO: 701 - RNA, 21 nt, synthetic construct
  source 1..21: mol_type = other RNA
tgtattctaattggcagatta

SEQ ID NO: 702 - RNA, 21 nt, synthetic construct
  source 1..21: mol_type = other RNA
gtattctaattggcagattga

SEQ ID NO: 703 - RNA, 21 nt, synthetic construct
  source 1..21: mol_type = other RNA
ttttcctaaggaaactgctta

SEQ ID NO: 704 - RNA, 21 nt, synthetic construct
  source 1..21: mol_type = other RNA
aaatgttcaaattcacgttca

SEQ ID NO: 705 - RNA, 21 nt, synthetic construct
  source 1..21: mol_type = other RNA
aatgttcaaattcacgttcta

SEQ ID NO: 706 - RNA, 21 nt, synthetic construct
  source 1..21: mol_type = other RNA
ttcaaattcacgttctagtga

SEQ ID NO: 707 - RNA, 21 nt, synthetic construct
  source 1..21: mol_type = other RNA
tcaaattcacgttctagtgaa

SEQ ID NO: 708 - RNA, 21 nt, synthetic construct
  source 1..21: mol_type = other RNA
caaattcacgttctagtgaaa

SEQ ID NO: 709 - RNA, 21 nt, synthetic construct
  source 1..21: mol_type = other RNA
aaattcacgttctagtgaaaa

SEQ ID NO: 710 - RNA, 21 nt, synthetic construct
  source 1..21: mol_type = other RNA
aattcacgttctagtgaaaca

SEQ ID NO: 711 - RNA, 21 nt, synthetic construct
  source 1..21: mol_type = other RNA
attcacgttctagtgaaacta

SEQ ID NO: 712 - RNA, 21 nt, synthetic construct
  source 1..21: mol_type = other RNA
tcacgttctagtgaaactgca

SEQ ID NO: 713 - RNA, 21 nt, synthetic construct
  source 1..21: mol_type = other RNA
cacgttctagtgaaactgcaa

SEQ ID NO: 714 - RNA, 21 nt, synthetic construct
  source 1..21: mol_type = other RNA
ttctagtgaaactgcattata

SEQ ID NO: 715 - RNA, 21 nt, synthetic construct
  source 1..21: mol_type = other RNA
cgggtgtgatcatatatcata

SEQ ID NO: 716 - RNA, 21 nt, synthetic construct
  source 1..21: mol_type = other RNA
gggtgtgatcatatatcataa

SEQ ID NO: 717 - RNA, 21 nt, synthetic construct
  source 1..21: mol_type = other RNA
ggtgtgatcatatatcataaa

SEQ ID NO: 718 - RNA, 21 nt, synthetic construct
  source 1..21: mol_type = other RNA
gtgtgatcatatatcataaaa

SEQ ID NO: 719 - RNA, 21 nt, synthetic construct
  source 1..21: mol_type = other RNA
tgtgatcatatatcataaaga

SEQ ID NO: 720 - RNA, 21 nt, synthetic construct
  source 1..21: mol_type = other RNA
gtgatcatatatcataaagga

SEQ ID NO: 721 - RNA, 21 nt, synthetic construct
  source 1..21: mol_type = other RNA
tgatcatatatcataaaggaa

SEQ ID NO: 722 - RNA, 21 nt, synthetic construct
  source 1..21: mol_type = other RNA
catatatcataaaggatatta

SEQ ID NO: 723 - RNA, 21 nt, synthetic construct
  source 1..21: mol_type = other RNA
aaaggatatttcaaatgatta

SEQ ID NO: 724 - RNA, 21 nt, synthetic construct
  source 1..21: mol_type = other RNA
aaggatatttcaaatgattaa

SEQ ID NO: 725 - RNA, 21 nt, synthetic construct
  source 1..21: mol_type = other RNA
aggatatttcaaatgattata

SEQ ID NO: 726 - RNA, 21 nt, synthetic construct
  source 1..21: mol_type = other RNA
tatttcaaatgattatgatta

SEQ ID NO: 727 - RNA, 21 nt, synthetic construct
  source 1..21: mol_type = other RNA
atttcaaatgattatgattaa

SEQ ID NO: 728 - RNA, 21 nt, synthetic construct
  source 1..21: mol_type = other RNA
tttcaaatgattatgattaga

SEQ ID NO: 729 - RNA, 21 nt, synthetic construct
  source 1..21: mol_type = other RNA
ttcaaatgattatgattagta

SEQ ID NO: 730 - RNA, 21 nt, synthetic construct
  source 1..21: mol_type = other RNA
caaatgattatgattagttaa

SEQ ID NO: 731 - RNA, 21 nt, synthetic construct
  source 1..21: mol_type = other RNA
aaatgattatgattagttata

SEQ ID NO: 732 - RNA, 21 nt, synthetic construct
  source 1..21: mol_type = other RNA
atgattatgattagttatgta

SEQ ID NO: 733 - RNA, 21 nt, synthetic construct
  source 1..21: mol_type = other RNA
tgattatgattagttatgtca

SEQ ID NO: 734 - RNA, 21 nt, synthetic construct
  source 1..21: mol_type = other RNA
gattatgattagttatgtcta

SEQ ID NO: 735 - RNA, 21 nt, synthetic construct
  source 1..21: mol_type = other RNA
ttgatttcccaaaaacactaa

SEQ ID NO: 736 - RNA, 21 nt, synthetic construct
  source 1..21: mol_type = other RNA
atttcccaaaaacactaaaga

SEQ ID NO: 737 - RNA, 21 nt, synthetic construct
  source 1..21: mol_type = other RNA
tttcccaaaaacactaaagga

SEQ ID NO: 738 - RNA, 21 nt, synthetic construct
  source 1..21: mol_type = other RNA
tcccaaaaacactaaaggtga

SEQ ID NO: 739 - RNA, 21 nt, synthetic construct
  source 1..21: mol_type = other RNA
cccaaaaacactaaaggtgga

SEQ ID NO: 740 - RNA, 21 nt, synthetic construct
  source 1..21: mol_type = other RNA
ccaaaaacactaaaggtggta

SEQ ID NO: 741 - RNA, 21 nt, synthetic construct
  source 1..21: mol_type = other RNA
tcatgttttaacttattgtta

SEQ ID NO: 742 - RNA, 21 nt, synthetic construct
  source 1..21: mol_type = other RNA
atgttttaacttattgttgca

SEQ ID NO: 743 - RNA, 21 nt, synthetic construct
  source 1..21: mol_type = other RNA
tgttttaacttattgttgcta

SEQ ID NO: 744 - RNA, 21 nt, synthetic construct
  source 1..21: mol_type = other RNA
aacttattgttgctgaaaaca

SEQ ID NO: 745 - RNA, 21 nt, synthetic construct
  source 1..21: mol_type = other RNA
cttattgttgctgaaaactca

SEQ ID NO: 746 - RNA, 21 nt, synthetic construct
  source 1..21: mol_type = other RNA
ttattgttgctgaaaactcta

SEQ ID NO: 747 - RNA, 21 nt, synthetic construct
  source 1..21: mol_type = other RNA
tattgttgctgaaaactctaa

SEQ ID NO: 748 - RNA, 21 nt, synthetic construct
  source 1..21: mol_type = other RNA
gttgctgaaaactctatgtca

SEQ ID NO: 749 - RNA, 21 nt, synthetic construct
  source 1..21: mol_type = other RNA
aaaaatgtagcttttatgtga

SEQ ID NO: 750 - RNA, 21 nt, synthetic construct
  source 1..21: mol_type = other RNA
ggaagctttggttatgaaaca

SEQ ID NO: 751 - RNA, 21 nt, synthetic construct
  source 1..21: mol_type = other RNA
gaagctttggttatgaaacaa

SEQ ID NO: 752 - RNA, 21 nt, synthetic construct
  source 1..21: mol_type = other RNA
atttaaatgctttttatcgca

SEQ ID NO: 753 - RNA, 21 nt, synthetic construct
  source 1..21: mol_type = other RNA
tttaaatgctttttatcgcta

SEQ ID NO: 754 - RNA, 21 nt, synthetic construct
  source 1..21: mol_type = other RNA
ttaaatgctttttatcgctaa

SEQ ID NO: 755 - RNA, 21 nt, synthetic construct
  source 1..21: mol_type = other RNA
taaatgctttttatcgctaaa

SEQ ID NO: 756 - RNA, 21 nt, synthetic construct
  source 1..21: mol_type = other RNA
aaatgctttttatcgctaaaa

SEQ ID NO: 757 - RNA, 21 nt, synthetic construct
  source 1..21: mol_type = other RNA
aatgctttttatcgctaaata

SEQ ID NO: 758 - RNA, 21 nt, synthetic construct
  source 1..21: mol_type = other RNA
ctttttatcgctaaatgacta

SEQ ID NO: 759 - RNA, 21 nt, synthetic construct
  source 1..21: mol_type = other RNA
tttttatcgctaaatgactta

SEQ ID NO: 760 - RNA, 21 nt, synthetic construct
  source 1..21: mol_type = other RNA
tttatcgctaaatgacttgca

SEQ ID NO: 761 - RNA, 21 nt, synthetic construct
  source 1..21: mol_type = other RNA
ttatcgctaaatgacttgcaa

SEQ ID NO: 762 - RNA, 21 nt, synthetic construct
  source 1..21: mol_type = other RNA
atcgctaaatgacttgcagaa

SEQ ID NO: 763 - RNA, 21 nt, synthetic construct
  source 1..21: mol_type = other RNA
ctaaatgacttgcagatgaaa

SEQ ID NO: 764 - RNA, 21 nt, synthetic construct
  source 1..21: mol_type = other RNA
tgtttaaatgctgtgtacaaa

SEQ ID NO: 765 - RNA, 21 nt, synthetic construct
  source 1..21: mol_type = other RNA
ttaaatgctgtgtacaacaaa

SEQ ID NO: 766 - RNA, 21 nt, synthetic construct
  source 1..21: mol_type = other RNA
taaatgctgtgtacaacaata

SEQ ID NO: 767 - RNA, 21 nt, synthetic construct
  source 1..21: mol_type = other RNA
tgctgtgtacaacaatgctta

SEQ ID NO: 768 - RNA, 21 nt, synthetic construct
  source 1..21: mol_type = other RNA
tgtgtacaacaatgctttgaa

SEQ ID NO: 769 - RNA, 21 nt, synthetic construct
  source 1..21: mol_type = other RNA
gtgtacaacaatgctttgata

SEQ ID NO: 770 - RNA, 21 nt, synthetic construct
  source 1..21: mol_type = other RNA
tgtacaacaatgctttgataa

SEQ ID NO: 771 - RNA, 21 nt, synthetic construct
  source 1..21: mol_type = other RNA
gataattttgaaatgattcaa

SEQ ID NO: 772 - RNA, 21 nt, synthetic construct
  source 1..21: mol_type = other RNA
ataattttgaaatgattcata

SEQ ID NO: 773 - RNA, 21 nt, synthetic construct
  source 1..21: mol_type = other RNA
taattttgaaatgattcatca

SEQ ID NO: 774 - RNA, 21 nt, synthetic construct
  source 1..21: mol_type = other RNA
ttttgaaatgattcatcttta

SEQ ID NO: 775 - RNA, 21 nt, synthetic construct
  source 1..21: mol_type = other RNA
tttgaaatgattcatctttca

SEQ ID NO: 776 - RNA, 21 nt, synthetic construct
  source 1..21: mol_type = other RNA
cagaaataaaagtatgaatca

SEQ ID NO: 777 - RNA, 23 nt, synthetic construct
  source 1..23: mol_type = other RNA
tccaaaatctctgaggaagaatt

SEQ ID NO: 778 - RNA, 23 nt, synthetic construct
  source 1..23: mol_type = other RNA
ttctaggccaaaatctctgagtt

SEQ ID NO: 779 - RNA, 23 nt, synthetic construct
  source 1..23: mol_type = other RNA
tatctaggccaaaatctctgatt

SEQ ID NO: 780 - RNA, 23 nt, synthetic construct
  source 1..23: mol_type = other RNA
taatctaggccaaaatctctgtt

SEQ ID NO: 781 - RNA, 23 nt, synthetic construct
  source 1..23: mol_type = other RNA
taaatctaggccaaaatctcttt

SEQ ID NO: 782 - RNA, 23 nt, synthetic construct
  source 1..23: mol_type = other RNA
tgcaaatctaggccaaaatcttt

SEQ ID NO: 783 - RNA, 23 nt, synthetic construct
  source 1..23: mol_type = other RNA
tccatagacaacagcatgctgtt

SEQ ID NO: 784 - RNA, 23 nt, synthetic construct
  source 1..23: mol_type = other RNA
tataagccatagacaacagcatt

SEQ ID NO: 785 - RNA, 23 nt, synthetic construct
  source 1..23: mol_type = other RNA
taataagccatagacaacagctt

SEQ ID NO: 786 - RNA, 23 nt, synthetic construct
  source 1..23: mol_type = other RNA
tgaataagccatagacaacagtt

SEQ ID NO: 787 - RNA, 23 nt, synthetic construct
  source 1..23: mol_type = other RNA
tagaataagccatagacaacatt

SEQ ID NO: 788 - RNA, 23 nt, synthetic construct
  source 1..23: mol_type = other RNA
tcaagaataagccatagacaatt

SEQ ID NO: 789 - RNA, 23 nt, synthetic construct
  source 1..23: mol_type = other RNA
tccaagaataagccatagacatt

SEQ ID NO: 790 - RNA, 23 nt, synthetic construct
  source 1..23: mol_type = other RNA
ttccaagaataagccatagactt

SEQ ID NO: 791 - RNA, 23 nt, synthetic construct
  source 1..23: mol_type = other RNA
tttccaagaataagccatagatt

SEQ ID NO: 792 - RNA, 23 nt, synthetic construct
  source 1..23: mol_type = other RNA
tcacccgtttgccttctcctatt

SEQ ID NO: 793 - RNA, 23 nt, synthetic construct
  source 1..23: mol_type = other RNA
tttcacccgtttgccttctcctt

SEQ ID NO: 794 - RNA, 23 nt, synthetic construct
  source 1..23: mol_type = other RNA
tgttcacccgtttgccttctctt

SEQ ID NO: 795 - RNA, 23 nt, synthetic construct
  source 1..23: mol_type = other RNA
tggttcacccgtttgccttcttt

SEQ ID NO: 796 - RNA, 23 nt, synthetic construct
  source 1..23: mol_type = other RNA
tcacagcccaggtatggaatttt

SEQ ID NO: 797 - RNA, 23 nt, synthetic construct
  source 1..23: mol_type = other RNA
tgcacagcccaggtatggaattt

SEQ ID NO: 798 - RNA, 23 nt, synthetic construct
  source 1..23: mol_type = other RNA
tagcacagcccaggtatggaatt

SEQ ID NO: 799 - RNA, 23 nt, synthetic construct
  source 1..23: mol_type = other RNA
tattggcaccaaattgcagagtt

SEQ ID NO: 800 - RNA, 23 nt, synthetic construct
  source 1..23: mol_type = other RNA
tggattggcaccaaattgcagtt

SEQ ID NO: 801 - RNA, 23 nt, synthetic construct
  source 1..23: mol_type = other RNA
tctcaagaggattggcaccaatt

SEQ ID NO: 802 - RNA, 23 nt, synthetic construct
  source 1..23: mol_type = other RNA
tggaactcaagaggattggcatt

SEQ ID NO: 803 - RNA, 23 nt, synthetic construct
  source 1..23: mol_type = other RNA
tttgctctgaggaactcaagatt

SEQ ID NO: 804 - RNA, 23 nt, synthetic construct
  source 1..23: mol_type = other RNA
tatttgctctgaggaactcaatt

SEQ ID NO: 805 - RNA, 23 nt, synthetic construct
  source 1..23: mol_type = other RNA
ttttgatttgctctgaggaactt

SEQ ID NO: 806 - RNA, 23 nt, synthetic construct
  source 1..23: mol_type = other RNA
tctttgatttgctctgaggaatt

SEQ ID NO: 807 - RNA, 23 nt, synthetic construct
  source 1..23: mol_type = other RNA
ttgtttcctttgatttgctcttt

SEQ ID NO: 808 - RNA, 23 nt, synthetic construct
  source 1..23: mol_type = other RNA
tcatgtttcctttgatttgcttt

SEQ ID NO: 809 - RNA, 23 nt, synthetic construct
  source 1..23: mol_type = other RNA
ttgaccatgtttcctttgatttt

SEQ ID NO: 810 - RNA, 23 nt, synthetic construct
  source 1..23: mol_type = other RNA
tatgaccatgtttcctttgattt

SEQ ID NO: 811 - RNA, 23 nt, synthetic construct
  source 1..23: mol_type = other RNA
tcatgaccatgtttcctttgatt

SEQ ID NO: 812 - RNA, 23 nt, synthetic construct
  source 1..23: mol_type = other RNA
tacatgaccatgtttcctttgtt

SEQ ID NO: 813 - RNA, 23 nt, synthetic construct
  source 1..23: mol_type = other RNA
taacatgaccatgtttccttttt

SEQ ID NO: 814 - RNA, 23 nt, synthetic construct
  source 1..23: mol_type = other RNA
tgtaaaaacatgaccatgttttt

SEQ ID NO: 815 - RNA, 23 nt, synthetic construct
  source 1..23: mol_type = other RNA
taggtaaaaacatgaccatgttt

SEQ ID NO: 816 - RNA, 23 nt, synthetic construct
  source 1..23: mol_type = other RNA
tcaggtaaaaacatgaccatgtt

SEQ ID NO: 817 - RNA, 23 nt, synthetic construct
  source 1..23: mol_type = other RNA
tttagtttgcaggtaaaaacatt

SEQ ID NO: 818 - RNA, 23 nt, synthetic construct
  source 1..23: mol_type = other RNA
tcattagtttgcaggtaaaaatt

SEQ ID NO: 819 - RNA, 23 nt, synthetic construct
  source 1..23: mol_type = other RNA
tcccattagtttgcaggtaaatt

SEQ ID NO: 820 - RNA, 23 nt, synthetic construct
  source 1..23: mol_type = other RNA
ttcccattagtttgcaggtaatt

SEQ ID NO: 821 - RNA, 23 nt, synthetic construct
  source 1..23: mol_type = other RNA
tttcccattagtttgcaggtatt

SEQ ID NO: 822 - RNA, 23 nt, synthetic construct
  source 1..23: mol_type = other RNA
tatttgtgatgaaatggacattt

SEQ ID NO: 823 - RNA, 23 nt, synthetic construct
  source 1..23: mol_type = other RNA
tgatttgtgatgaaatggacatt

SEQ ID NO: 824 - RNA, 23 nt, synthetic construct
  source 1..23: mol_type = other RNA
tgggatttgtgatgaaatggatt

SEQ ID NO: 825 - RNA, 23 nt, synthetic construct
  source 1..23: mol_type = other RNA
ttgacaagggatttgtgatgatt

SEQ ID NO: 826 - RNA, 23 nt, synthetic construct
  source 1..23: mol_type = other RNA
ttatgacaagggatttgtgattt

SEQ ID NO: 827 - RNA, 23 nt, synthetic construct
  source 1..23: mol_type = other RNA
tgtatgacaagggatttgtgatt

SEQ ID NO: 828 - RNA, 23 nt, synthetic construct
  source 1..23: mol_type = other RNA
tggtatgacaagggatttgtgtt

SEQ ID NO: 829 - RNA, 23 nt, synthetic construct
  source 1..23: mol_type = other RNA
ttggtatgacaagggatttgttt

SEQ ID NO: 830 - RNA, 23 nt, synthetic construct
  source 1..23: mol_type = other RNA
tcttatggtatgacaagggattt

SEQ ID NO: 831 - RNA, 23 nt, synthetic construct
  source 1..23: mol_type = other RNA
tccttatggtatgacaagggatt

SEQ ID NO: 832 - RNA, 23 nt, synthetic construct
  source 1..23: mol_type = other RNA
taccttatggtatgacaagggtt

SEQ ID NO: 833 - RNA, 23 nt, synthetic construct
  source 1..23: mol_type = other RNA
tcaccttatggtatgacaaggtt

SEQ ID NO: 834 - RNA, 23 nt, synthetic construct
  source 1..23: mol_type = other RNA
tacaccttatggtatgacaagtt

SEQ ID NO: 835 - RNA, 23 nt, synthetic construct
  source 1..23: mol_type = other RNA
tcaacaccttatggtatgacatt

SEQ ID NO: 836 - RNA, 23 nt, synthetic construct
  source 1..23: mol_type = other RNA
tggcacaacaccttatggtattt

SEQ ID NO: 837 - RNA, 23 nt, synthetic construct
  source 1..23: mol_type = other RNA
tagtagcaaagtgaaattttttt

SEQ ID NO: 838 - RNA, 23 nt, synthetic construct
  source 1..23: mol_type = other RNA
tagaagtagcaaagtgaaatttt

SEQ ID NO: 839 - RNA, 23 nt, synthetic construct
  source 1..23: mol_type = other RNA
ttgccttcgcagaagtagcaatt

SEQ ID NO: 840 - RNA, 23 nt, synthetic construct
  source 1..23: mol_type = other RNA
taaatgccttcgcagaagtagtt

SEQ ID NO: 841 - RNA, 23 nt, synthetic construct
  source 1..23: mol_type = other RNA
tccaaatgccttcgcagaagttt

SEQ ID NO: 842 - RNA, 23 nt, synthetic construct
  source 1..23: mol_type = other RNA
taatgcttctgtgcccaaatgtt

SEQ ID NO: 843 - RNA, 23 nt, synthetic construct
  source 1..23: mol_type = other RNA
ttcaatgcttctgtgcccaaatt

SEQ ID NO: 844 - RNA, 23 nt, synthetic construct
  source 1..23: mol_type = other RNA
tggtcaatgcttctgtgcccatt

SEQ ID NO: 845 - RNA, 23 nt, synthetic construct
  source 1..23: mol_type = other RNA
tcgtgagggaattcaaggcattt

SEQ ID NO: 846 - RNA, 23 nt, synthetic construct
  source 1..23: mol_type = other RNA
tccgtgagggaattcaaggcatt

SEQ ID NO: 847 - RNA, 23 nt, synthetic construct
  source 1..23: mol_type = other RNA
ttccgtgagggaattcaaggctt

SEQ ID NO: 848 - RNA, 23 nt, synthetic construct
  source 1..23: mol_type = other RNA
tttccgtgagggaattcaaggtt

SEQ ID NO: 849 - RNA, 23 nt, synthetic construct
  source 1..23: mol_type = other RNA
ttttccgtgagggaattcaagtt

SEQ ID NO: 850 - RNA, 23 nt, synthetic construct
  source 1..23: mol_type = other RNA
tatgctttccgtgagggaatttt

SEQ ID NO: 851 - RNA, 23 nt, synthetic construct
  source 1..23: mol_type = other RNA
ttcatgctttccgtgagggaatt

SEQ ID NO: 852 - RNA, 23 nt, synthetic construct
  source 1..23: mol_type = other RNA
tcatcatgctttccgtgagggtt

SEQ ID NO: 853 - RNA, 23 nt, synthetic construct
  source 1..23: mol_type = other RNA
ttccatcatgctttccgtgagtt

SEQ ID NO: 854 - RNA, 23 nt, synthetic construct
  source 1..23: mol_type = other RNA
tacgttggaggttttccatcatt

SEQ ID NO: 855 - RNA, 23 nt, synthetic construct
  source 1..23: mol_type = other RNA
tatacgttggaggttttccattt

SEQ ID NO: 856 - RNA, 23 nt, synthetic construct
  source 1..23: mol_type = other RNA
ttgatacgttggaggttttcctt

SEQ ID NO: 857 - RNA, 23 nt, synthetic construct
  source 1..23: mol_type = other RNA
tatgatacgttggaggttttctt

SEQ ID NO: 858 - RNA, 23 nt, synthetic construct
  source 1..23: mol_type = other RNA
tcatgatacgttggaggtttttt

SEQ ID NO: 859 - RNA, 23 nt, synthetic construct
  source 1..23: mol_type = other RNA
tctcatgatacgttggaggtttt

SEQ ID NO: 860 - RNA, 23 nt, synthetic construct
  source 1..23: mol_type = other RNA
ttctcatgatacgttggaggttt

SEQ ID NO: 861 - RNA, 23 nt, synthetic construct
  source 1..23: mol_type = other RNA
tgtctcatgatacgttggaggtt

SEQ ID NO: 862 - RNA, 23 nt, synthetic construct
  source 1..23: mol_type = other RNA
tggtctcatgatacgttggagtt

SEQ ID NO: 863 - RNA, 23 nt, synthetic construct
  source 1..23: mol_type = other RNA
taggtctcatgatacgttggatt

SEQ ID NO: 864 - RNA, 23 nt, synthetic construct
  source 1..23: mol_type = other RNA
tgaggtctcatgatacgttggtt

SEQ ID NO: 865 - RNA, 23 nt, synthetic construct
  source 1..23: mol_type = other RNA
tgcggtctttgagttagaggatt

SEQ ID NO: 866 - RNA, 23 nt, synthetic construct
  source 1..23: mol_type = other RNA
ttgtcacccaggcagcggtcttt

SEQ ID NO: 867 - RNA, 23 nt, synthetic construct
  source 1..23: mol_type = other RNA
tacatcccttctgtcacccagtt

SEQ ID NO: 868 - RNA, 23 nt, synthetic construct
  source 1..23: mol_type = other RNA
ttacatcccttctgtcacccatt

SEQ ID NO: 869 - RNA, 23 nt, synthetic construct
  source 1..23: mol_type = other RNA
tatacatcccttctgtcaccctt

SEQ ID NO: 870 - RNA, 23 nt, synthetic construct
  source 1..23: mol_type = other RNA
tcatcactcggtagcagaaagtt

SEQ ID NO: 871 - RNA, 23 nt, synthetic construct
  source 1..23: mol_type = other RNA
taacatcactcggtagcagaatt

SEQ ID NO: 872 - RNA, 23 nt, synthetic construct
  source 1..23: mol_type = other RNA
taaacatcactcggtagcagatt

SEQ ID NO: 873 - RNA, 23 nt, synthetic construct
  source 1..23: mol_type = other RNA
tcaaacatcactcggtagcagtt

SEQ ID NO: 874 - RNA, 23 nt, synthetic construct
  source 1..23: mol_type = other RNA
tgcttcaaacatcactcggtatt

SEQ ID NO: 875 - RNA, 23 nt, synthetic construct
  source 1..23: mol_type = other RNA
tagcttcaaacatcactcggttt

SEQ ID NO: 876 - RNA, 23 nt, synthetic construct
  source 1..23: mol_type = other RNA
tcagcttcaaacatcactcggtt

SEQ ID NO: 877 - RNA, 23 nt, synthetic construct
  source 1..23: mol_type = other RNA
taaatacccagcttcaaacattt

SEQ ID NO: 878 - RNA, 23 nt, synthetic construct
  source 1..23: mol_type = other RNA
tgttaaatacccagcttcaaatt

SEQ ID NO: 879 - RNA, 23 nt, synthetic construct
  source 1..23: mol_type = other RNA
tagttaaatacccagcttcaatt

SEQ ID NO: 880 - RNA, 23 nt, synthetic construct
  source 1..23: mol_type = other RNA
ttagttaaatacccagcttcatt

SEQ ID NO: 881 - RNA, 23 nt, synthetic construct
  source 1..23: mol_type = other RNA
tatagttaaatacccagcttctt

SEQ ID NO: 882 - RNA, 23 nt, synthetic construct
  source 1..23: mol_type = other RNA
tgatagttaaatacccagctttt

SEQ ID NO: 883 - RNA, 23 nt, synthetic construct
  source 1..23: mol_type = other RNA
tagatagttaaatacccagcttt

SEQ ID NO: 884 - RNA, 23 nt, synthetic construct
  source 1..23: mol_type = other RNA
taaagatagttaaatacccagtt

SEQ ID NO: 885 - RNA, 23 nt, synthetic construct
  source 1..23: mol_type = other RNA
tcaaagatagttaaatacccatt

SEQ ID NO: 886 - RNA, 23 nt, synthetic construct
  source 1..23: mol_type = other RNA
tatatgtgctttctgtgtgtctt

SEQ ID NO: 887 - RNA, 23 nt, synthetic construct
  source 1..23: mol_type = other RNA
tattgtttagaatatgtgctttt

SEQ ID NO: 888 - RNA, 23 nt, synthetic construct
  source 1..23: mol_type = other RNA
tagattgtttagaatatgtgctt

SEQ ID NO: 889 - RNA, 23 nt, synthetic construct
  source 1..23: mol_type = other RNA
taagattgtttagaatatgtgtt

SEQ ID NO: 890 - RNA, 23 nt, synthetic construct
  source 1..23: mol_type = other RNA
tcaagattgtttagaatatgttt

SEQ ID NO: 891 - RNA, 23 nt, synthetic construct
  source 1..23: mol_type = other RNA
tgtcaagattgtttagaatattt

SEQ ID NO: 892 - RNA, 23 nt, synthetic construct
  source 1..23: mol_type = other RNA
ttgtcaagattgtttagaatatt

SEQ ID NO: 893 - RNA, 23 nt, synthetic construct
  source 1..23: mol_type = other RNA
tttgtcaagattgtttagaattt

SEQ ID NO: 894 - RNA, 23 nt, synthetic construct
  source 1..23: mol_type = other RNA
tagttgtcaagattgtttagatt

SEQ ID NO: 895 - RNA, 23 nt, synthetic construct
  source 1..23: mol_type = other RNA
tgcttgaagttgtcaagattgtt

SEQ ID NO: 896 - RNA, 23 nt, synthetic construct
  source 1..23: mol_type = other RNA
tctgctaccagggctggaaagtt

SEQ ID NO: 897 - RNA, 23 nt, synthetic construct
  source 1..23: mol_type = other RNA
tgctctctgccagtttctccctt

SEQ ID NO: 898 - RNA, 23 nt, synthetic construct
  source 1..23: mol_type = other RNA
tcgtgcctcaagctctctgcctt

SEQ ID NO: 899 - RNA, 23 nt, synthetic construct
  source 1..23: mol_type = other RNA
taggttctcgtgcctcaagcttt

SEQ ID NO: 900 - RNA, 23 nt, synthetic construct
  source 1..23: mol_type = other RNA
tcattgagaaacatgcgcaggtt

SEQ ID NO: 901 - RNA, 23 nt, synthetic construct
  source 1..23: mol_type = other RNA
ttgtcattgagaaacatgcgctt

SEQ ID NO: 902 - RNA, 23 nt, synthetic construct
  source 1..23: mol_type = other RNA
tagtgtcattgagaaacatgctt

SEQ ID NO: 903 - RNA, 23 nt, synthetic construct
  source 1..23: mol_type = other RNA
tacaaagtgtcattgagaaactt

SEQ ID NO: 904 - RNA, 23 nt, synthetic construct
  source 1..23: mol_type = other RNA
tgacaaagtgtcattgagaaatt

SEQ ID NO: 905 - RNA, 23 nt, synthetic construct
  source 1..23: mol_type = other RNA
tggacaaagtgtcattgagaatt

SEQ ID NO: 906 - RNA, 23 nt, synthetic construct
  source 1..23: mol_type = other RNA
tatcaaaggtggacaaagtgttt

SEQ ID NO: 907 - RNA, 23 nt, synthetic construct
  source 1..23: mol_type = other RNA
tcatcaaaggtggacaaagtgtt

SEQ ID NO: 908 - RNA, 23 nt, synthetic construct
  source 1..23: mol_type = other RNA
tcccagaggaccacgaggtgttt

SEQ ID NO: 909 - RNA, 23 nt, synthetic construct
  source 1..23: mol_type = other RNA
ttgcccagaggaccacgaggttt

SEQ ID NO: 910 - RNA, 23 nt, synthetic construct
  source 1..23: mol_type = other RNA
tatgcccagaggaccacgaggtt

SEQ ID NO: 911 - RNA, 23 nt, synthetic construct
  source 1..23: mol_type = other RNA
tgatgcccagaggaccacgagtt

SEQ ID NO: 912 - RNA, 23 nt, synthetic construct
  source 1..23: mol_type = other RNA
tcgatgcccagaggaccacgatt

SEQ ID NO: 913 - RNA, 23 nt, synthetic construct
  source 1..23: mol_type = other RNA
ttgcttgcgatgcccagaggatt

SEQ ID NO: 914 - RNA, 23 nt, synthetic construct
  source 1..23: mol_type = other RNA
tgtttgcttgcgatgcccagatt

SEQ ID NO: 915 - RNA, 23 nt, synthetic construct
  source 1..23: mol_type = other RNA
ttgtttgcttgcgatgcccagtt

SEQ ID NO: 916 - RNA, 23 nt, synthetic construct
  source 1..23: mol_type = other RNA
tgtgtttgcttgcgatgcccatt

SEQ ID NO: 917 - RNA, 23 nt, synthetic construct
  source 1..23: mol_type = other RNA
tatggtgtttgcttgcgatgctt

SEQ ID NO: 918 - RNA, 23 nt, synthetic construct
  source 1..23: mol_type = other RNA
taatggtgtttgcttgcgatgtt

SEQ ID NO: 919 - RNA, 23 nt, synthetic construct
  source 1..23: mol_type = other RNA
tatttgaaataaactccagaatt

SEQ ID NO: 920 - RNA, 23 nt, synthetic construct
  source 1..23: mol_type = other RNA
taatcatttgaaataaactcctt

SEQ ID NO: 921 - RNA, 23 nt, synthetic construct
  source 1..23: mol_type = other RNA
ttaatcatttgaaataaactctt

SEQ ID NO: 922 - RNA, 23 nt, synthetic construct
  source 1..23: mol_type = other RNA
tctaatcatttgaaataaacttt

SEQ ID NO: 923 - RNA, 23 nt, synthetic construct
  source 1..23: mol_type = other RNA
tcctaatcatttgaaataaactt

SEQ ID NO: 924 - RNA, 23 nt, synthetic construct
  source 1..23: mol_type = other RNA
tgctgctttcattgcttctggtt

SEQ ID NO: 925 - RNA, 23 nt, synthetic construct
  source 1..23: mol_type = other RNA
ttagctgctttcattgcttcttt

SEQ ID NO: 926 - RNA, 23 nt, synthetic construct
  source 1..23: mol_type = other RNA
tgtagctgctttcattgcttctt

SEQ ID NO: 927 - RNA, 23 nt, synthetic construct
  source 1..23: mol_type = other RNA
tcttcagtagctgctttcatttt

SEQ ID NO: 928 - RNA, 23 nt, synthetic construct
  source 1..23: mol_type = other RNA
ttcttcagtagctgctttcattt

SEQ ID NO: 929 - RNA, 23 nt, synthetic construct
  source 1..23: mol_type = other RNA
tacttcttcagtagctgcttttt

SEQ ID NO: 930 - RNA, 23 nt, synthetic construct
  source 1..23: mol_type = other RNA
tcacttcttcagtagctgctttt

SEQ ID NO: 931 - RNA, 23 nt, synthetic construct
  source 1..23: mol_type = other RNA
ttcacttcttcagtagctgcttt

SEQ ID NO: 932 - RNA, 23 nt, synthetic construct
  source 1..23: mol_type = other RNA
tttcacttcttcagtagctgctt

SEQ ID NO: 933 - RNA, 23 nt, synthetic construct
  source 1..23: mol_type = other RNA
ttttcacttcttcagtagctgtt

SEQ ID NO: 934 - RNA, 23 nt, synthetic construct
  source 1..23: mol_type = other RNA
ttaatgttcttttcacttctttt

SEQ ID NO: 935 - RNA, 23 nt, synthetic construct
  source 1..23: mol_type = other RNA
tctaatgttcttttcacttcttt

SEQ ID NO: 936 - RNA, 23 nt, synthetic construct
  source 1..23: mol_type = other RNA
ttctaatgttcttttcacttctt

SEQ ID NO: 937 - RNA, 23 nt, synthetic construct
  source 1..23: mol_type = other RNA
tattctctaatgttcttttcatt

SEQ ID NO: 938 - RNA, 23 nt, synthetic construct
  source 1..23: mol_type = other RNA
tcattctctaatgttcttttctt

SEQ ID NO: 939 - RNA, 23 nt, synthetic construct
  source 1..23: mol_type = other RNA
tgcattctctaatgttctttttt

SEQ ID NO: 940 - RNA, 23 nt, synthetic construct
  source 1..23: mol_type = other RNA
tgaccagcattctctaatgtttt

SEQ ID NO: 941 - RNA, 23 nt, synthetic construct
  source 1..23: mol_type = other RNA
ttgaccagcattctctaatgttt

SEQ ID NO: 942 - RNA, 23 nt, synthetic construct
  source 1..23: mol_type = other RNA
tttgaccagcattctctaatgtt

SEQ ID NO: 943 - RNA, 23 nt, synthetic construct
  source 1..23: mol_type = other RNA
ttttgaccagcattctctaattt

SEQ ID NO: 944 - RNA, 23 nt, synthetic construct
  source 1..23: mol_type = other RNA
tgactttttgaccagcattcttt

SEQ ID NO: 945 - RNA, 23 nt, synthetic construct
  source 1..23: mol_type = other RNA
ttgactttttgaccagcattctt

SEQ ID NO: 946 - RNA, 23 nt, synthetic construct
  source 1..23: mol_type = other RNA
tgctgactttttgaccagcattt

SEQ ID NO: 947 - RNA, 23 nt, synthetic construct
  source 1..23: mol_type = other RNA
tcttccaagctgactttttgatt

SEQ ID NO: 948 - RNA, 23 nt, synthetic construct
  source 1..23: mol_type = other RNA
ttgccttccaagctgactttttt

SEQ ID NO: 949 - RNA, 23 nt, synthetic construct
  source 1..23: mol_type = other RNA
tgattgccttccaagctgacttt

SEQ ID NO: 950 - RNA, 23 nt, synthetic construct
  source 1..23: mol_type = other RNA
tatactggcaggtcattcagttt

SEQ ID NO: 951 - RNA, 23 nt, synthetic construct
  source 1..23: mol_type = other RNA
tctaatactggcaggtcattctt

SEQ ID NO: 952 - RNA, 23 nt, synthetic construct
  source 1..23: mol_type = other RNA
tgttgagggaggcactggaaatt

SEQ ID NO: 953 - RNA, 23 nt, synthetic construct
  source 1..23: mol_type = other RNA
ttccttagctgtccggatgtttt

SEQ ID NO: 954 - RNA, 23 nt, synthetic construct
  source 1..23: mol_type = other RNA
tctccttagctgtccggatgttt

SEQ ID NO: 955 - RNA, 23 nt, synthetic construct
  source 1..23: mol_type = other RNA
tatcctccttagctgtccggatt

SEQ ID NO: 956 - RNA, 23 nt, synthetic construct
  source 1..23: mol_type = other RNA
tgaaatcctccttagctgtcctt

SEQ ID NO: 957 - RNA, 23 nt, synthetic construct
  source 1..23: mol_type = other RNA
tgtgaaatcctccttagctgttt

SEQ ID NO: 958 - RNA, 23 nt, synthetic construct
  source 1..23: mol_type = other RNA
taagtgaaatcctccttagcttt

SEQ ID NO: 959 - RNA, 23 nt, synthetic construct
  source 1..23: mol_type = other RNA
tgcaaagtgaaatcctccttatt

SEQ ID NO: 960 - RNA, 23 nt, synthetic construct
  source 1..23: mol_type = other RNA
tggtgcaaagtgaaatcctcctt

SEQ ID NO: 961 - RNA, 23 nt, synthetic construct
  source 1..23: mol_type = other RNA
taggtgcaaagtgaaatcctctt

SEQ ID NO: 962 - RNA, 23 nt, synthetic construct
  source 1..23: mol_type = other RNA
tcctcaaggtgcaaagtgaaatt

SEQ ID NO: 963 - RNA, 23 nt, synthetic construct
  source 1..23: mol_type = other RNA
tcgtcctcaaggtgcaaagtgtt

SEQ ID NO: 964 - RNA, 23 nt, synthetic construct
  source 1..23: mol_type = other RNA
tccgtcctcaaggtgcaaagttt

SEQ ID NO: 965 - RNA, 23 nt, synthetic construct
  source 1..23: mol_type = other RNA
ttgttgtaggaaccgtcctcatt

SEQ ID NO: 966 - RNA, 23 nt, synthetic construct
  source 1..23: mol_type = other RNA
tgatgttgtaggaaccgtccttt

SEQ ID NO: 967 - RNA, 23 nt, synthetic construct
  source 1..23: mol_type = other RNA
ttcggatgttgtaggaaccgttt

SEQ ID NO: 968 - RNA, 23 nt, synthetic construct
  source 1..23: mol_type = other RNA
ttttcggatgttgtaggaacctt

SEQ ID NO: 969 - RNA, 23 nt, synthetic construct
  source 1..23: mol_type = other RNA
tatcttttcggatgttgtaggtt

SEQ ID NO: 970 - RNA, 23 nt, synthetic construct
  source 1..23: mol_type = other RNA
tcatcttttcggatgttgtagtt

SEQ ID NO: 971 - RNA, 23 nt, synthetic construct
  source 1..23: mol_type = other RNA
tgtcatcttttcggatgttgttt

SEQ ID NO: 972 - RNA, 23 nt, synthetic construct
  source 1..23: mol_type = other RNA
ttgtcatcttttcggatgttgtt

SEQ ID NO: 973 - RNA, 23 nt, synthetic construct
  source 1..23: mol_type = other RNA
tatgtcatcttttcggatgtttt

SEQ ID NO: 974 - RNA, 23 nt, synthetic construct
  source 1..23: mol_type = other RNA
ttgatgtcatcttttcggatgtt

SEQ ID NO: 975 - RNA, 23 nt, synthetic construct
  source 1..23: mol_type = other RNA
ttatgatgtcatcttttcggatt

SEQ ID NO: 976 - RNA, 23 nt, synthetic construct
  source 1..23: mol_type = other RNA
tagctatgatgtcatcttttctt

SEQ ID NO: 977 - RNA, 23 nt, synthetic construct
  source 1..23: mol_type = other RNA
tagagctatgatgtcatcttttt

SEQ ID NO: 978 - RNA, 23 nt, synthetic construct
  source 1..23: mol_type = other RNA
taagagctatgatgtcatctttt

SEQ ID NO: 979 - RNA, 23 nt, synthetic construct
  source 1..23: mol_type = other RNA
ttaaagagctatgatgtcatctt

SEQ ID NO: 980 - RNA, 23 nt, synthetic construct
  source 1..23: mol_type = other RNA
taactgtgggtaaagagctattt

SEQ ID NO: 981 - RNA, 23 nt, synthetic construct
  source 1..23: mol_type = other RNA
ttaactgtgggtaaagagctatt

SEQ ID NO: 982 - RNA, 23 nt, synthetic construct
  source 1..23: mol_type = other RNA
tttaactgtgggtaaagagcttt

SEQ ID NO: 983 - RNA, 23 nt, synthetic construct
  source 1..23: mol_type = other RNA
tattaactgtgggtaaagagctt

SEQ ID NO: 984 - RNA, 23 nt, synthetic construct
  source 1..23: mol_type = other RNA
tcattaactgtgggtaaagagtt

SEQ ID NO: 985 - RNA, 23 nt, synthetic construct
  source 1..23: mol_type = other RNA
tgcattaactgtgggtaaagatt

SEQ ID NO: 986 - RNA, 23 nt, synthetic construct
  source 1..23: mol_type = other RNA
tgtgcattaactgtgggtaaatt

SEQ ID NO: 987 - RNA, 23 nt, synthetic construct
  source 1..23: mol_type = other RNA
ttaagtgcattaactgtgggttt

SEQ ID NO: 988 - RNA, 23 nt, synthetic construct
  source 1..23: mol_type = other RNA
tctaagtgcattaactgtgggtt

SEQ ID NO: 989 - RNA, 23 nt, synthetic construct
  source 1..23: mol_type = other RNA
ttctaagtgcattaactgtggtt

SEQ ID NO: 990 - RNA, 23 nt, synthetic construct
  source 1..23: mol_type = other RNA
tatctaagtgcattaactgtgtt

SEQ ID NO: 991 - RNA, 23 nt, synthetic construct
  source 1..23: mol_type = other RNA
tgatctaagtgcattaactgttt

SEQ ID NO: 992 - RNA, 23 nt, synthetic construct
  source 1..23: mol_type = other RNA
tggatctaagtgcattaactgtt

SEQ ID NO: 993 - RNA, 23 nt, synthetic construct
  source 1..23: mol_type = other RNA
ttggatctaagtgcattaacttt

SEQ ID NO: 994 - RNA, 23 nt, synthetic construct
  source 1..23: mol_type = other RNA
tgatttctggatctaagtgcatt

SEQ ID NO: 995 - RNA, 23 nt, synthetic construct
  source 1..23: mol_type = other RNA
tagatttctggatctaagtgctt

SEQ ID NO: 996 - RNA, 23 nt, synthetic construct
  source 1..23: mol_type = other RNA
taagggtctgggtagatttcttt

SEQ ID NO: 997 - RNA, 23 nt, synthetic construct
  source 1..23: mol_type = other RNA
ttacctatcatatttaaaagttt

SEQ ID NO: 998 - RNA, 23 nt, synthetic construct
  source 1..23: mol_type = other RNA
tgatacctatcatatttaaaatt

SEQ ID NO: 999 - RNA, 23 nt, synthetic construct
  source 1..23: mol_type = other RNA
tagatacctatcatatttaaatt

SEQ ID NO: 1000 - RNA, 23 nt, synthetic construct
  source 1..23: mol_type = other RNA
tcaagatacctatcatatttatt

SEQ ID NO: 1001 - RNA, 23 nt, synthetic construct
  source 1..23: mol_type = other RNA
tatcaagatacctatcatatttt

SEQ ID NO: 1002 - RNA, 23 nt, synthetic construct
  source 1..23: mol_type = other RNA
tcatcaagatacctatcatattt

SEQ ID NO: 1003 - RNA, 23 nt, synthetic construct
  source 1..23: mol_type = other RNA
ttcatcaagatacctatcatatt

SEQ ID NO: 1004 - RNA, 23 nt, synthetic construct
  source 1..23: mol_type = other RNA
tttcatcaagatacctatcattt

SEQ ID NO: 1005 - RNA, 23 nt, synthetic construct
  source 1..23: mol_type = other RNA
tgttttcatcaagatacctattt

SEQ ID NO: 1006 - RNA, 23 nt, synthetic construct
  source 1..23: mol_type = other RNA
tcgttttcatcaagatacctatt

SEQ ID NO: 1007 - RNA, 23 nt, synthetic construct
  source 1..23: mol_type = other RNA
tccgttttcatcaagataccttt

SEQ ID NO: 1008 - RNA, 23 nt, synthetic construct
  source 1..23: mol_type = other RNA
tcccgttttcatcaagatacctt

SEQ ID NO: 1009 - RNA, 23 nt, synthetic construct
  source 1..23: mol_type = other RNA
ttcccgttttcatcaagatactt

SEQ ID NO: 1010 - RNA, 23 nt, synthetic construct
  source 1..23: mol_type = other RNA
tttcccgttttcatcaagatatt

SEQ ID NO: 1011 - RNA, 23 nt, synthetic construct
  source 1..23: mol_type = other RNA
tcttcccgttttcatcaagattt

SEQ ID NO: 1012 - RNA, 23 nt, synthetic construct
  source 1..23: mol_type = other RNA
ttcttcccgttttcatcaagatt

SEQ ID NO: 1013 - RNA, 23 nt, synthetic construct
  source 1..23: mol_type = other RNA
tttgtcttcccgttttcatcatt

SEQ ID NO: 1014 - RNA, 23 nt, synthetic construct
  source 1..23: mol_type = other RNA
ttttgtcttcccgttttcatctt

SEQ ID NO: 1015 - RNA, 23 nt, synthetic construct
  source 1..23: mol_type = other RNA
tagtctttgtcttcccgtttttt

SEQ ID NO: 1016 - RNA, 23 nt, synthetic construct
  source 1..23: mol_type = other RNA
tgtagtctttgtcttcccgtttt

SEQ ID NO: 1017 - RNA, 23 nt, synthetic construct
  source 1..23: mol_type = other RNA
tggtagtctttgtcttcccgttt

SEQ ID NO: 1018 - RNA, 23 nt, synthetic construct
  source 1..23: mol_type = other RNA
tcatgtagtaatactttaacttt

SEQ ID NO: 1019 - RNA, 23 nt, synthetic construct
  source 1..23: mol_type = other RNA
tgcatgtagtaatactttaactt

SEQ ID NO: 1020 - RNA, 23 nt, synthetic construct
  source 1..23: mol_type = other RNA
taagggcatgtagtaatactttt

SEQ ID NO: 1021 - RNA, 23 nt, synthetic construct
  source 1..23: mol_type = other RNA
tcaaagggcatgtagtaatactt

SEQ ID NO: 1022 - RNA, 23 nt, synthetic construct
  source 1..23: mol_type = other RNA
tccaaagggcatgtagtaatatt

SEQ ID NO: 1023 - RNA, 23 nt, synthetic construct
  source 1..23: mol_type = other RNA
tatccaaagggcatgtagtaatt

SEQ ID NO: 1024 - RNA, 23 nt, synthetic construct
  source 1..23: mol_type = other RNA
tgatccaaagggcatgtagtatt

SEQ ID NO: 1025 - RNA, 23 nt, synthetic construct
  source 1..23: mol_type = other RNA
tggacatattgtagctcccgatt

SEQ ID NO: 1026 - RNA, 23 nt, synthetic construct
  source 1..23: mol_type = other RNA
ttccaggacatattgtagctctt

SEQ ID NO: 1027 - RNA, 23 nt, synthetic construct
  source 1..23: mol_type = other RNA
tcttccaggacatattgtagctt

SEQ ID NO: 1028 - RNA, 23 nt, synthetic construct
  source 1..23: mol_type = other RNA
ttcttccaggacatattgtagtt

SEQ ID NO: 1029 - RNA, 23 nt, synthetic construct
  source 1..23: mol_type = other RNA
tcttgatttcgtggatagcgatt

SEQ ID NO: 1030 - RNA, 23 nt, synthetic construct
  source 1..23: mol_type = other RNA
ttgcttgatttcgtggatagctt

SEQ ID NO: 1031 - RNA, 23 nt, synthetic construct
  source 1..23: mol_type = other RNA
tttgcttgatttcgtggatagtt

SEQ ID NO: 1032 - RNA, 23 nt, synthetic construct
  source 1..23: mol_type = other RNA
tattgcttgatttcgtggatatt

SEQ ID NO: 1033 - RNA, 23 nt, synthetic construct
  source 1..23: mol_type = other RNA
tatcaaaaattgcttgatttctt

SEQ ID NO: 1034 - RNA, 23 nt, synthetic construct
  source 1..23: mol_type = other RNA
taatcaaaaattgcttgattttt

SEQ ID NO: 1035 - RNA, 23 nt, synthetic construct
  source 1..23: mol_type = other RNA
tcatcagaatcaaaaattgcttt

SEQ ID NO: 1036 - RNA, 23 nt, synthetic construct
  source 1..23: mol_type = other RNA
tagcatcagaatcaaaaattgtt

SEQ ID NO: 1037 - RNA, 23 nt, synthetic construct
  source 1..23: mol_type = other RNA
tcaagcctgcccgggactggttt

SEQ ID NO: 1038 - RNA, 23 nt, synthetic construct
  source 1..23: mol_type = other RNA
tccaagcctgcccgggactggtt

SEQ ID NO: 1039 - RNA, 23 nt, synthetic construct
  source 1..23: mol_type = other RNA
ttgcccaagcctgcccgggactt

SEQ ID NO: 1040 - RNA, 23 nt, synthetic construct
  source 1..23: mol_type = other RNA
tatgcccaagcctgcccgggatt

SEQ ID NO: 1041 - RNA, 23 nt, synthetic construct
  source 1..23: mol_type = other RNA
taaatgcccaagcctgcccggtt

SEQ ID NO: 1042 - RNA, 23 nt, synthetic construct
  source 1..23: mol_type = other RNA
tcggcaaaatgcccaagcctgtt

SEQ ID NO: 1043 - RNA, 23 nt, synthetic construct
  source 1..23: mol_type = other RNA
tgcttgaatttatatttaaattt

SEQ ID NO: 1044 - RNA, 23 nt, synthetic construct
  source 1..23: mol_type = other RNA
ttgcttgaatttatatttaaatt

SEQ ID NO: 1045 - RNA, 23 nt, synthetic construct
  source 1..23: mol_type = other RNA
tatgcttgaatttatatttaatt

SEQ ID NO: 1046 - RNA, 23 nt, synthetic construct
  source 1..23: mol_type = other RNA
taatgcttgaatttatatttatt

SEQ ID NO: 1047 - RNA, 23 nt, synthetic construct
  source 1..23: mol_type = other RNA
taaatgcttgaatttatattttt

SEQ ID NO: 1048 - RNA, 23 nt, synthetic construct
  source 1..23: mol_type = other RNA
tacaaatgcttgaatttatattt

SEQ ID NO: 1049 - RNA, 23 nt, synthetic construct
  source 1..23: mol_type = other RNA
tatctagtgtcctcttattcctt

SEQ ID NO: 1050 - RNA, 23 nt, synthetic construct
  source 1..23: mol_type = other RNA
tcatctagtgtcctcttattctt

SEQ ID NO: 1051 - RNA, 23 nt, synthetic construct
  source 1..23: mol_type = other RNA
ttatcatctagtgtcctcttatt

SEQ ID NO: 1052 - RNA, 23 nt, synthetic construct
  source 1..23: mol_type = other RNA
taatatcatctagtgtcctcttt

SEQ ID NO: 1053 - RNA, 23 nt, synthetic construct
  source 1..23: mol_type = other RNA
tgtaatatcatctagtgtccttt

SEQ ID NO: 1054 - RNA, 23 nt, synthetic construct
  source 1..23: mol_type = other RNA
ttcctgtaatatcatctagtgtt

SEQ ID NO: 1055 - RNA, 23 nt, synthetic construct
  source 1..23: mol_type = other RNA
tgtcctgtaatatcatctagttt

SEQ ID NO: 1056 - RNA, 23 nt, synthetic construct
  source 1..23: mol_type = other RNA
tgcagtcctgtaatatcatcttt

SEQ ID NO: 1057 - RNA, 23 nt, synthetic construct
  source 1..23: mol_type = other RNA
ttgcagtcctgtaatatcatctt

SEQ ID NO: 1058 - RNA, 23 nt, synthetic construct
  source 1..23: mol_type = other RNA
tgttctgcagtcctgtaatattt

SEQ ID NO: 1059 - RNA, 23 nt, synthetic construct
  source 1..23: mol_type = other RNA
tccaaagggactgtgtggtgatt

SEQ ID NO: 1060 - RNA, 23 nt, synthetic construct
  source 1..23: mol_type = other RNA
ttaccaccactaaatgcattttt

SEQ ID NO: 1061 - RNA, 23 nt, synthetic construct
  source 1..23: mol_type = other RNA
tctaccaccactaaatgcatttt

SEQ ID NO: 1062 - RNA, 23 nt, synthetic construct
  source 1..23: mol_type = other RNA
ttctaccaccactaaatgcattt

SEQ ID NO: 1063 - RNA, 23 nt, synthetic construct
  source 1..23: mol_type = other RNA
tttctaccaccactaaatgcatt

SEQ ID NO: 1064 - RNA, 23 nt, synthetic construct
  source 1..23: mol_type = other RNA
taatcatttctaccaccactatt

SEQ ID NO: 1065 - RNA, 23 nt, synthetic construct
  source 1..23: mol_type = other RNA
ttgaatcatttctaccaccactt

SEQ ID NO: 1066 - RNA, 23 nt, synthetic construct
  source 1..23: mol_type = other RNA
tggtgaatcatttctaccacctt

SEQ ID NO: 1067 - RNA, 23 nt, synthetic construct
  source 1..23: mol_type = other RNA
tcctggtgaatcatttctacctt

SEQ ID NO: 1068 - RNA, 23 nt, synthetic construct
  source 1..23: mol_type = other RNA
tcattggacctggtgaatcattt

SEQ ID NO: 1069 - RNA, 23 nt, synthetic construct
  source 1..23: mol_type = other RNA
tcaacattggacctggtgaattt

SEQ ID NO: 1070 - RNA, 23 nt, synthetic construct
  source 1..23: mol_type = other RNA
tgaacaacattggacctggtgtt

SEQ ID NO: 1071 - RNA, 23 nt, synthetic construct
  source 1..23: mol_type = other RNA
ttgaacaacattggacctggttt

SEQ ID NO: 1072 - RNA, 23 nt, synthetic construct
  source 1..23: mol_type = other RNA
tggtgaacaacattggacctgtt

SEQ ID NO: 1073 - RNA, 23 nt, synthetic construct
  source 1..23: mol_type = other RNA
taagattcacaagcaagcacttt

SEQ ID NO: 1074 - RNA, 23 nt, synthetic construct
  source 1..23: mol_type = other RNA
ttaagattcacaagcaagcactt

SEQ ID NO: 1075 - RNA, 23 nt, synthetic construct
  source 1..23: mol_type = other RNA
ttagttcttttcactagcagatt

SEQ ID NO: 1076 - RNA, 23 nt, synthetic construct
  source 1..23: mol_type = other RNA
tctagttcttttcactagcagtt

SEQ ID NO: 1077 - RNA, 23 nt, synthetic construct
  source 1..23: mol_type = other RNA
ttatgaacattcatggacttatt

SEQ ID NO: 1078 - RNA, 23 nt, synthetic construct
  source 1..23: mol_type = other RNA
tatatgaacattcatggactttt

SEQ ID NO: 1079 - RNA, 23 nt, synthetic construct
  source 1..23: mol_type = other RNA
ttatatgaacattcatggacttt

SEQ ID NO: 1080 - RNA, 23 nt, synthetic construct
  source 1..23: mol_type = other RNA
tctatatgaacattcatggactt

SEQ ID NO: 1081 - RNA, 23 nt, synthetic construct
  source 1..23: mol_type = other RNA
tgctatatgaacattcatggatt

SEQ ID NO: 1082 - RNA, 23 nt, synthetic construct
  source 1..23: mol_type = other RNA
tggctatatgaacattcatggtt

SEQ ID NO: 1083 - RNA, 23 nt, synthetic construct
  source 1..23: mol_type = other RNA
ttggctatatgaacattcatgtt

SEQ ID NO: 1084 - RNA, 23 nt, synthetic construct
  source 1..23: mol_type = other RNA
ttatcttcattttgaaaaaaatt

SEQ ID NO: 1085 - RNA, 23 nt, synthetic construct
  source 1..23: mol_type = other RNA
taatctgccaattagaatacatt

SEQ ID NO: 1086 - RNA, 23 nt, synthetic construct
  source 1..23: mol_type = other RNA
tcaatctgccaattagaatactt

SEQ ID NO: 1087 - RNA, 23 nt, synthetic construct
  source 1..23: mol_type = other RNA
taagcagtttccttaggaaaatt

SEQ ID NO: 1088 - RNA, 23 nt, synthetic construct
  source 1..23: mol_type = other RNA
tgaacgtgaatttgaacattttt

SEQ ID NO: 1089 - RNA, 23 nt, synthetic construct
  source 1..23: mol_type = other RNA
tagaacgtgaatttgaacatttt

SEQ ID NO: 1090 - RNA, 23 nt, synthetic construct
  source 1..23: mol_type = other RNA
tcactagaacgtgaatttgaatt

SEQ ID NO: 1091 - RNA, 23 nt, synthetic construct
  source 1..23: mol_type = other RNA
ttcactagaacgtgaatttgatt

SEQ ID NO: 1092 - RNA, 23 nt, synthetic construct
  source 1..23: mol_type = other RNA
tttcactagaacgtgaatttgtt

SEQ ID NO: 1093 - RNA, 23 nt, synthetic construct
  source 1..23: mol_type = other RNA
ttttcactagaacgtgaattttt

SEQ ID NO: 1094 - RNA, 23 nt, synthetic construct
  source 1..23: mol_type = other RNA
tgtttcactagaacgtgaatttt

SEQ ID NO: 1095 - RNA, 23 nt, synthetic construct
  source 1..23: mol_type = other RNA
tagtttcactagaacgtgaattt

SEQ ID NO: 1096 - RNA, 23 nt, synthetic construct
  source 1..23: mol_type = other RNA
tgcagtttcactagaacgtgatt

SEQ ID NO: 1097 - RNA, 23 nt, synthetic construct
  source 1..23: mol_type = other RNA
ttgcagtttcactagaacgtgtt

SEQ ID NO: 1098 - RNA, 23 nt, synthetic construct
  source 1..23: mol_type = other RNA
tataatgcagtttcactagaatt

SEQ ID NO: 1099 - RNA, 23 nt, synthetic construct
  source 1..23: mol_type = other RNA
tatgatatatgatcacacccgtt

SEQ ID NO: 1100 - RNA, 23 nt, synthetic construct
  source 1..23: mol_type = other RNA
ttatgatatatgatcacaccctt

SEQ ID NO: 1101 - RNA, 23 nt, synthetic construct
  source 1..23: mol_type = other RNA
tttatgatatatgatcacacctt

SEQ ID NO: 1102 - RNA, 23 nt, synthetic construct
  source 1..23: mol_type = other RNA
ttttatgatatatgatcacactt

SEQ ID NO: 1103 - RNA, 23 nt, synthetic construct
  source 1..23: mol_type = other RNA
tctttatgatatatgatcacatt

SEQ ID NO: 1104 - RNA, 23 nt, synthetic construct
  source 1..23: mol_type = other RNA
tcctttatgatatatgatcactt

SEQ ID NO: 1105 - RNA, 23 nt, synthetic construct
  source 1..23: mol_type = other RNA
ttcctttatgatatatgatcatt

SEQ ID NO: 1106 - RNA, 23 nt, synthetic construct
  source 1..23: mol_type = other RNA
taatatcctttatgatatatgtt

SEQ ID NO: 1107 - RNA, 23 nt, synthetic construct
  source 1..23: mol_type = other RNA
taatcatttgaaatatccttttt

SEQ ID NO: 1108 - RNA, 23 nt, synthetic construct
  source 1..23: mol_type = other RNA
ttaatcatttgaaatatcctttt

SEQ ID NO: 1109 - RNA, 23 nt, synthetic construct
  source 1..23: mol_type = other RNA
tataatcatttgaaatatccttt

SEQ ID NO: 1110 - RNA, 23 nt, synthetic construct
  source 1..23: mol_type = other RNA
taatcataatcatttgaaatatt

SEQ ID NO: 1111 - RNA, 23 nt, synthetic construct
  source 1..23: mol_type = other RNA
ttaatcataatcatttgaaattt

SEQ ID NO: 1112 - RNA, 23 nt, synthetic construct
  source 1..23: mol_type = other RNA
tctaatcataatcatttgaaatt

SEQ ID NO: 1113 - RNA, 23 nt, synthetic construct
  source 1..23: mol_type = other RNA
tactaatcataatcatttgaatt

SEQ ID NO: 1114 - RNA, 23 nt, synthetic construct
  source 1..23: mol_type = other RNA
ttaactaatcataatcatttgtt

SEQ ID NO: 1115 - RNA, 23 nt, synthetic construct
  source 1..23: mol_type = other RNA
tataactaatcataatcattttt

SEQ ID NO: 1116 - RNA, 23 nt, synthetic construct
  source 1..23: mol_type = other RNA
tacataactaatcataatcattt

SEQ ID NO: 1117 - RNA, 23 nt, synthetic construct
  source 1..23: mol_type = other RNA
tgacataactaatcataatcatt

SEQ ID NO: 1118 - RNA, 23 nt, synthetic construct
  source 1..23: mol_type = other RNA
tagacataactaatcataatctt

SEQ ID NO: 1119 - RNA, 23 nt, synthetic construct
  source 1..23: mol_type = other RNA
ttagtgtttttgggaaatcaatt

SEQ ID NO: 1120 - RNA, 23 nt, synthetic construct
  source 1..23: mol_type = other RNA
tctttagtgtttttgggaaattt

SEQ ID NO: 1121 - RNA, 23 nt, synthetic construct
  source 1..23: mol_type = other RNA
tcctttagtgtttttgggaaatt

SEQ ID NO: 1122 - RNA, 23 nt, synthetic construct
  source 1..23: mol_type = other RNA
tcacctttagtgtttttgggatt

SEQ ID NO: 1123 - RNA, 23 nt, synthetic construct
  source 1..23: mol_type = other RNA
tccacctttagtgtttttgggtt

SEQ ID NO: 1124 - RNA, 23 nt, synthetic construct
  source 1..23: mol_type = other RNA
taccacctttagtgtttttggtt

SEQ ID NO: 1125 - RNA, 23 nt, synthetic construct
  source 1..23: mol_type = other RNA
taacaataagttaaaacatgatt

SEQ ID NO: 1126 - RNA, 23 nt, synthetic construct
  source 1..23: mol_type = other RNA
tgcaacaataagttaaaacattt

SEQ ID NO: 1127 - RNA, 23 nt, synthetic construct
  source 1..23: mol_type = other RNA
tagcaacaataagttaaaacatt

SEQ ID NO: 1128 - RNA, 23 nt, synthetic construct
  source 1..23: mol_type = other RNA
tgttttcagcaacaataagtttt

SEQ ID NO: 1129 - RNA, 23 nt, synthetic construct
  source 1..23: mol_type = other RNA
tgagttttcagcaacaataagtt

SEQ ID NO: 1130 - RNA, 23 nt, synthetic construct
  source 1..23: mol_type = other RNA
tagagttttcagcaacaataatt

SEQ ID NO: 1131 - RNA, 23 nt, synthetic construct
  source 1..23: mol_type = other RNA
ttagagttttcagcaacaatatt

SEQ ID NO: 1132 - RNA, 23 nt, synthetic construct
  source 1..23: mol_type = other RNA
tgacatagagttttcagcaactt

SEQ ID NO: 1133 - RNA, 23 nt, synthetic construct
  source 1..23: mol_type = other RNA
tcacataaaagctacattttttt

SEQ ID NO: 1134 - RNA, 23 nt, synthetic construct
  source 1..23: mol_type = other RNA
tgtttcataaccaaagcttcctt

SEQ ID NO: 1135 - RNA, 23 nt, synthetic construct
  source 1..23: mol_type = other RNA
ttgtttcataaccaaagcttctt

SEQ ID NO: 1136 - RNA, 23 nt, synthetic construct
  source 1..23: mol_type = other RNA
tgcgataaaaagcatttaaattt

SEQ ID NO: 1137 - RNA, 23 nt, synthetic construct
  source 1..23: mol_type = other RNA
tagcgataaaaagcatttaaatt

SEQ ID NO: 1138 - RNA, 23 nt, synthetic construct
  source 1..23: mol_type = other RNA
ttagcgataaaaagcatttaatt

SEQ ID NO: 1139 - RNA, 23 nt, synthetic construct
  source 1..23: mol_type = other RNA
tttagcgataaaaagcatttatt

SEQ ID NO: 1140 - RNA, 23 nt, synthetic construct
  source 1..23: mol_type = other RNA
ttttagcgataaaaagcattttt

SEQ ID NO: 1141 - RNA, 23 nt, synthetic construct
  source 1..23: mol_type = other RNA
tatttagcgataaaaagcatttt

SEQ ID NO: 1142 - RNA, 23 nt, synthetic construct
  source 1..23: mol_type = other RNA
tagtcatttagcgataaaaagtt

SEQ ID NO: 1143 - RNA, 23 nt, synthetic construct
  source 1..23: mol_type = other RNA
taagtcatttagcgataaaaatt

SEQ ID NO: 1144 - RNA, 23 nt, synthetic construct
  source 1..23: mol_type = other RNA
tgcaagtcatttagcgataaatt

SEQ ID NO: 1145 - RNA, 23 nt, synthetic construct
  source 1..23: mol_type = other RNA
ttgcaagtcatttagcgataatt

SEQ ID NO: 1146 - RNA, 23 nt, synthetic construct
  source 1..23: mol_type = other RNA
ttctgcaagtcatttagcgattt

SEQ ID NO: 1147 - RNA, 23 nt, synthetic construct
  source 1..23: mol_type = other RNA
tttcatctgcaagtcatttagtt

SEQ ID NO: 1148 - RNA, 23 nt, synthetic construct
  source 1..23: mol_type = other RNA
tttgtacacagcatttaaacatt

SEQ ID NO: 1149 - RNA, 23 nt, synthetic construct
  source 1..23: mol_type = other RNA
tttgttgtacacagcatttaatt

SEQ ID NO: 1150 - RNA, 23 nt, synthetic construct
  source 1..23: mol_type = other RNA
tattgttgtacacagcatttatt

SEQ ID NO: 1151 - RNA, 23 nt, synthetic construct
  source 1..23: mol_type = other RNA
taagcattgttgtacacagcatt

SEQ ID NO: 1152 - RNA, 23 nt, synthetic construct
  source 1..23: mol_type = other RNA
ttcaaagcattgttgtacacatt

SEQ ID NO: 1153 - RNA, 23 nt, synthetic construct
  source 1..23: mol_type = other RNA
tatcaaagcattgttgtacactt

SEQ ID NO: 1154 - RNA, 23 nt, synthetic construct
  source 1..23: mol_type = other RNA
ttatcaaagcattgttgtacatt

SEQ ID NO: 1155 - RNA, 23 nt, synthetic construct
  source 1..23: mol_type = other RNA
ttgaatcatttcaaaattatctt

SEQ ID NO: 1156 - RNA, 23 nt, synthetic construct
  source 1..23: mol_type = other RNA
tatgaatcatttcaaaattattt

SEQ ID NO: 1157 - RNA, 23 nt, synthetic construct
  source 1..23: mol_type = other RNA
tgatgaatcatttcaaaattatt

SEQ ID NO: 1158 - RNA, 23 nt, synthetic construct
  source 1..23: mol_type = other RNA
taaagatgaatcatttcaaaatt

SEQ ID NO: 1159 - RNA, 23 nt, synthetic construct
  source 1..23: mol_type = other RNA
tgaaagatgaatcatttcaaatt

SEQ ID NO: 1160 - RNA, 23 nt, synthetic construct
  source 1..23: mol_type = other RNA
tgattcatacttttatttctgtt

SEQ ID NO: 1161 - RNA, 23 nt, synthetic construct
  source 1..23: mol_type = other RNA
tttgctctgaggaactcaagaag

SEQ ID NO: 1162 - RNA, 23 nt, synthetic construct
  source 1..23: mol_type = other RNA
ttgtcattgagaaacatgcgcag

SEQ ID NO: 1163 - RNA, 23 nt, synthetic construct
  source 1..23: mol_type = other RNA
tattgcttgatttcgtggataag

SEQ ID NO: 1164 - RNA, 23 nt, synthetic construct
  source 1..23: mol_type = other RNA
ttgccttccaagctgacttttag

SEQ ID NO: 1165 - RNA, 23 nt, synthetic construct
  source 1..23: mol_type = other RNA
ttaactgtgggtaaagagctaag

SEQ ID NO: 1166 - RNA, 23 nt, synthetic construct
  source 1..23: mol_type = other RNA
tatactggcaggtcattcagtag

SEQ ID NO: 1167 - RNA, 23 nt, synthetic construct
  source 1..23: mol_type = other RNA
tattctctaatgttcttttcaag

SEQ ID NO: 1168 - RNA, 23 nt, synthetic construct
  source 1..23: mol_type = other RNA
tgatgttgtaggaaccgtcctag

SEQ ID NO: 1169 - RNA, 23 nt, synthetic construct
  source 1..23: mol_type = other RNA
tgatttgtgatgaaatggacaag

SEQ ID NO: 1170 - RNA, 23 nt, synthetic construct
  source 1..23: mol_type = other RNA
tagttgtcaagattgtttagaag

SEQ ID NO: 1171 - RNA, 23 nt, synthetic construct
  source 1..23: mol_type = other RNA
tccgttttcatcaagatacctag

SEQ ID NO: 1172 - RNA, 23 nt, synthetic construct
  source 1..23: mol_type = other RNA
tacaaatgcttgaatttatatag

SEQ ID NO: 1173 - RNA, 23 nt, synthetic construct
  source 1..23: mol_type = other RNA
tctaagtgcattaactgtgggag

SEQ ID NO: 1174 - RNA, 23 nt, synthetic construct
  source 1..23: mol_type = other RNA
tttaactgtgggtaaagagctag

SEQ ID NO: 1175 - RNA, 23 nt, synthetic construct
  source 1..23: mol_type = other RNA
ttccaggacatattgtagctcag

SEQ ID NO: 1176 - RNA, 23 nt, synthetic construct
  source 1..23: mol_type = other RNA
ttaaagagctatgatgtcatcag

SEQ ID NO: 1177 - RNA, 23 nt, synthetic construct
  source 1..23: mol_type = other RNA
ttttccgtgagggaattcaagag

SEQ ID NO: 1178 - RNA, 23 nt, synthetic construct
  source 1..23: mol_type = other RNA
tcagcttcaaacatcactcggag

SEQ ID NO: 1179 - RNA, 23 nt, synthetic construct
  source 1..23: mol_type = other RNA
tcatcaagatacctatcatatag

SEQ ID NO: 1180 - RNA, 23 nt, synthetic construct
  source 1..23: mol_type = other RNA
tcaagaataagccatagacaaag

SEQ ID NO: 1181 - RNA, 23 nt, synthetic construct
  source 1..23: mol_type = other RNA
tttccgtgagggaattcaaggag

SEQ ID NO: 1182 - RNA, 23 nt, synthetic construct
  source 1..23: mol_type = other RNA
ttaatgttcttttcacttcttag

SEQ ID NO: 1183 - RNA, 23 nt, synthetic construct
  source 1..23: mol_type = other RNA
tgtaaaaacatgaccatgtttag

SEQ ID NO: 1184 - RNA, 23 nt, synthetic construct
  source 1..23: mol_type = other RNA
tgtatgacaagggatttgtgaag

SEQ ID NO: 1185 - RNA, 23 nt, synthetic construct
  source 1..23: mol_type = other RNA
ttatgatgtcatcttttcggaag

SEQ ID NO: 1186 - RNA, 23 nt, synthetic construct
  source 1..23: mol_type = other RNA
tcattgagaaacatgcgcaggag

SEQ ID NO: 1187 - RNA, 23 nt, synthetic construct
  source 1..23: mol_type = other RNA
tcgtgcctcaagctctctgccag

SEQ ID NO: 1188 - RNA, 23 nt, synthetic construct
  source 1..23: mol_type = other RNA
taaatacccagcttcaaacatag

SEQ ID NO: 1189 - RNA, 23 nt, synthetic construct
  source 1..23: mol_type = other RNA
tagcatcagaatcaaaaattgag

SEQ ID NO: 1190 - RNA, 23 nt, synthetic construct
  source 1..23: mol_type = other RNA
tatgatacgttggaggttttcag

SEQ ID NO: 1191 - RNA, 21 nt, synthetic construct
  source 1..21: mol_type = other RNA
  modified_base order(1..8,14..18,20..21): mod_base = OTHER; note = 2 prime-O-methyl nucleosides
ttcttcctcagagattttgga

SEQ ID NO: 1192 - RNA, 21 nt, synthetic construct
  source 1..21: mol_type = other RNA
  modified_base order(1..8,14..18,20..21): mod_base = OTHER; note = 2 prime-O-methyl nucleosides
ctcagagattttggcctagaa

SEQ ID NO: 1193 - RNA, 21 nt, synthetic construct
  source 1..21: mol_type = other RNA
  modified_base order(1..8,14..18,20..21): mod_base = OTHER; note = 2 prime-O-methyl nucleosides
tcagagattttggcctagata

SEQ ID NO: 1194 - RNA, 21 nt, synthetic construct
  source 1..21: mol_type = other RNA
  modified_base order(1..8,14..18,20..21): mod_base = OTHER; note = 2 prime-O-methyl nucleosides
cagagattttggcctagatta

SEQ ID NO: 1195 - RNA, 21 nt, synthetic construct
  source 1..21: mol_type = other RNA
  modified_base order(1..8,14..18,20..21): mod_base = OTHER; note = 2 prime-O-methyl nucleosides
agagattttggcctagattta

SEQ ID NO: 1196 - RNA, 21 nt, synthetic construct
  source 1..21: mol_type = other RNA
  modified_base order(1..8,14..18,20..21): mod_base = OTHER; note = 2 prime-O-methyl nucleosides
agattttggcctagatttgca

SEQ ID NO: 1197 - RNA, 21 nt, synthetic construct
  source 1..21: mol_type = other RNA
  modified_base order(1..8,14..18,20..21): mod_base = OTHER; note = 2 prime-O-methyl nucleosides
cagcatgctgttgtctatgga

SEQ ID NO: 1198 - RNA, 21 nt, synthetic construct
  source 1..21: mol_type = other RNA
  modified_base order(1..8,14..18,20..21): mod_base = OTHER; note = 2 prime-O-methyl nucleosides
tgctgttgtctatggcttata

SEQ ID NO: 1199 - RNA, 21 nt, synthetic construct
  source 1..21: mol_type = other RNA
  modified_base order(1..8,14..18,20..21): mod_base = OTHER; note = 2 prime-O-methyl nucleosides
gctgttgtctatggcttatta

SEQ ID NO: 1200 - RNA, 21 nt, synthetic construct
  source 1..21: mol_type = other RNA
  modified_base order(1..8,14..18,20..21): mod_base = OTHER; note = 2 prime-O-methyl nucleosides
ctgttgtctatggcttattca

SEQ ID NO: 1201 - RNA, 21 nt, synthetic construct
  source 1..21: mol_type = other RNA
  modified_base order(1..8,14..18,20..21): mod_base = OTHER; note = 2 prime-O-methyl nucleosides
tgttgtctatggcttattcta

SEQ ID NO: 1202 - RNA, 21 nt, synthetic construct
  source 1..21: mol_type = other RNA
  modified_base order(1..3,>21): mod_base = OTHER; note = phosphorothioate linkages
  modified_base order(1..8,13..21): mod_base = OTHER; note = 2 prime-O-methyl nucleosides
  modified_base 9..12: mod_base = OTHER; note = 2 prime-fluoro nucleosides
ttgtctatggcttattcttga

SEQ ID NO: 1203 - RNA, 21 nt, synthetic construct
  source 1..21: mol_type = other RNA
  modified_base order(1..8,14..18,20..21): mod_base = OTHER; note = 2 prime-O-methyl nucleosides
ttgtctatggcttattcttga

SEQ ID NO: 1204 - RNA, 21 nt, synthetic construct
  source 1..21: mol_type = other RNA
  modified_base order(1..8,14..18,20..21): mod_base = OTHER; note = 2 prime-O-methyl nucleosides
tgtctatggcttattcttgga

SEQ ID NO: 1205 - RNA, 21 nt, synthetic construct
  source 1..21: mol_type = other RNA
  modified_base order(1..8,14..18,20..21): mod_base = OTHER; note = 2 prime-O-methyl nucleosides
gtctatggcttattcttggaa

SEQ ID NO: 1206 - RNA, 21 nt, synthetic construct
  source 1..21: mol_type = other RNA
  modified_base order(1..8,14..18,20..21): mod_base = OTHER; note = 2 prime-O-methyl nucleosides
tctatggcttattcttggaaa

SEQ ID NO: 1207 - RNA, 21 nt, synthetic construct
  source 1..21: mol_type = other RNA
  modified_base order(1..8,14..18,20..21): mod_base = OTHER; note = 2 prime-O-methyl nucleosides
taggagaaggcaaacgggtga

SEQ ID NO: 1208 - RNA, 21 nt, synthetic construct
  source 1..21: mol_type = other RNA
  modified_base order(1..8,14..18,20..21): mod_base = OTHER; note = 2 prime-O-methyl nucleosides
ggagaaggcaaacgggtgaaa

SEQ ID NO: 1209 - RNA, 21 nt, synthetic construct
  source 1..21: mol_type = other RNA
  modified_base order(1..8,14..18,20..21): mod_base = OTHER; note = 2 prime-O-methyl nucleosides
gagaaggcaaacgggtgaaca

SEQ ID NO: 1210 - RNA, 21 nt, synthetic construct
  source 1..21: mol_type = other RNA
  modified_base order(1..8,14..18,20..21): mod_base = OTHER; note = 2 prime-O-methyl nucleosides
agaaggcaaacgggtgaacca

SEQ ID NO: 1211 - RNA, 21 nt, synthetic construct
  source 1..21: mol_type = other RNA
  modified_base order(1..8,14..18,20..21): mod_base = OTHER; note = 2 prime-O-methyl nucleosides
aattccatacctgggctgtga

SEQ ID NO: 1212 - RNA, 21 nt, synthetic construct
  source 1..21: mol_type = other RNA
  modified_base order(1..8,14..18,20..21): mod_base = OTHER; note = 2 prime-O-methyl nucleosides
attccatacctgggctgtgca

SEQ ID NO: 1213 - RNA, 21 nt, synthetic construct
  source 1..21: mol_type = other RNA
  modified_base order(1..8,14..18,20..21): mod_base = OTHER; note = 2 prime-O-methyl nucleosides
ttccatacctgggctgtgcta

SEQ ID NO: 1214 - RNA, 21 nt, synthetic construct
  source 1..21: mol_type = other RNA
  modified_base order(1..8,14..18,20..21): mod_base = OTHER; note = 2 prime-O-methyl nucleosides
ctctgcaatttggtgccaata

SEQ ID NO: 1215 - RNA, 21 nt, synthetic construct
  source 1..21: mol_type = other RNA
  modified_base order(1..8,14..18,20..21): mod_base = OTHER; note = 2 prime-O-methyl nucleosides
ctgcaatttggtgccaatcca

SEQ ID NO: 1216 - RNA, 21 nt, synthetic construct
  source 1..21: mol_type = other RNA
  modified_base order(1..8,14..18,20..21): mod_base = OTHER; note = 2 prime-O-methyl nucleosides
ttggtgccaatcctcttgaga

SEQ ID NO: 1217 - RNA, 21 nt, synthetic construct
  source 1..21: mol_type = other RNA
  modified_base order(1..8,14..18,20..21): mod_base = OTHER; note = 2 prime-O-methyl nucleosides
tgccaatcctcttgagttcca

SEQ ID NO: 1218 - RNA, 21 nt, synthetic construct
  source 1..21: mol_type = other RNA
  modified_base order(1..8,14..18,20..21): mod_base = OTHER; note = 2 prime-O-methyl nucleosides
tcttgagttcctcagagcaaa

SEQ ID NO: 1219 - RNA, 21 nt, synthetic construct
  source 1..21: mol_type = other RNA
  modified_base order(1..3,>21): mod_base = OTHER; note = phosphorothioate linkages
  modified_base order(1..8,13..21): mod_base = OTHER; note = 2 prime-O-methyl nucleosides
  modified_base 9..12: mod_base = OTHER; note = 2 prime-fluoro nucleosides
tcttgagttcctcagagcaaa

SEQ ID NO: 1220 - RNA, 21 nt, synthetic construct
  source 1..21: mol_type = other RNA
  modified_base order(1..8,14..18,20..21): mod_base = OTHER; note = 2 prime-O-methyl nucleosides
ttgagttcctcagagcaaata

SEQ ID NO: 1221 - RNA, 21 nt, synthetic construct
  source 1..21: mol_type = other RNA
  modified_base order(1..8,14..18,20..21): mod_base = OTHER; note = 2 prime-O-methyl nucleosides
gttcctcagagcaaatcaaaa

SEQ ID NO: 1222 - RNA, 21 nt, synthetic construct
  source 1..21: mol_type = other RNA
  modified_base order(1..8,14..18,20..21): mod_base = OTHER; note = 2 prime-O-methyl nucleosides
ttcctcagagcaaatcaaaga

SEQ ID NO: 1223 - RNA, 21 nt, synthetic construct
  source 1..21: mol_type = other RNA
  modified_base order(1..8,14..18,20..21): mod_base = OTHER; note = 2 prime-O-methyl nucleosides
agagcaaatcaaaggaaacaa

SEQ ID NO: 1224 - RNA, 21 nt, synthetic construct
  source 1..21: mol_type = other RNA
  modified_base order(1..8,14..18,20..21): mod_base = OTHER; note = 2 prime-O-methyl nucleosides
agcaaatcaaaggaaacatga

SEQ ID NO: 1225 - RNA, 21 nt, synthetic construct
  source 1..21: mol_type = other RNA
  modified_base order(1..8,14..18,20..21): mod_base = OTHER; note = 2 prime-O-methyl nucleosides
aatcaaaggaaacatggtcaa

SEQ ID NO: 1226 - RNA, 21 nt, synthetic construct
  source 1..21: mol_type = other RNA
  modified_base order(1..8,14..18,20..21): mod_base = OTHER; note = 2 prime-O-methyl nucleosides
atcaaaggaaacatggtcata

SEQ ID NO: 1227 - RNA, 21 nt, synthetic construct
  source 1..21: mol_type = other RNA
  modified_base order(1..8,14..18,20..21): mod_base = OTHER; note = 2 prime-O-methyl nucleosides
tcaaaggaaacatggtcatga

SEQ ID NO: 1228 - RNA, 21 nt, synthetic construct
  source 1..21: mol_type = other RNA
  modified_base order(1..8,14..18,20..21): mod_base = OTHER; note = 2 prime-O-methyl nucleosides
caaaggaaacatggtcatgta

SEQ ID NO: 1229 - RNA, 21 nt, synthetic construct
  source 1..21: mol_type = other RNA
  modified_base order(1..8,14..18,20..21): mod_base = OTHER; note = 2 prime-O-methyl nucleosides
aaaggaaacatggtcatgtta

SEQ ID NO: 1230 - RNA, 21 nt, synthetic construct
  source 1..21: mol_type = other RNA
  modified_base order(1..8,14..18,20..21): mod_base = OTHER; note = 2 prime-O-methyl nucleosides
aaacatggtcatgtttttaca

SEQ ID NO: 1231 - RNA, 21 nt, synthetic construct
  source 1..21: mol_type = other RNA
  modified_base order(1..8,14..18,20..21): mod_base = OTHER; note = 2 prime-O-methyl nucleosides
acatggtcatgtttttaccta

SEQ ID NO: 1232 - RNA, 21 nt, synthetic construct
  source 1..21: mol_type = other RNA
  modified_base order(1..8,14..18,20..21): mod_base = OTHER; note = 2 prime-O-methyl nucleosides
catggtcatgtttttacctga

SEQ ID NO: 1233 - RNA, 21 nt, synthetic construct
  source 1..21: mol_type = other RNA
  modified_base order(1..8,14..18,20..21): mod_base = OTHER; note = 2 prime-O-methyl nucleosides
tgtttttacctgcaaactaaa

SEQ ID NO: 1234 - RNA, 21 nt, synthetic construct
  source 1..21: mol_type = other RNA
  modified_base order(1..8,14..18,20..21): mod_base = OTHER; note = 2 prime-O-methyl nucleosides
tttttacctgcaaactaatga

SEQ ID NO: 1235 - RNA, 21 nt, synthetic construct
  source 1..21: mol_type = other RNA
  modified_base order(1..8,14..18,20..21): mod_base = OTHER; note = 2 prime-O-methyl nucleosides
tttacctgcaaactaatggga

SEQ ID NO: 1236 - RNA, 21 nt, synthetic construct
  source 1..21: mol_type = other RNA
  modified_base order(1..8,14..18,20..21): mod_base = OTHER; note = 2 prime-O-methyl nucleosides
ttacctgcaaactaatgggaa

SEQ ID NO: 1237 - RNA, 21 nt, synthetic construct
  source 1..21: mol_type = other RNA
  modified_base order(1..8,14..18,20..21): mod_base = OTHER; note = 2 prime-O-methyl nucleosides
tacctgcaaactaatgggaaa

SEQ ID NO: 1238 - RNA, 21 nt, synthetic construct
  source 1..21: mol_type = other RNA
  modified_base order(1..8,14..18,20..21): mod_base = OTHER; note = 2 prime-O-methyl nucleosides
atgtccatttcatcacaaata

SEQ ID NO: 1239 - RNA, 21 nt, synthetic construct
  source 1..21: mol_type = other RNA
  modified_base order(1..8,14..18,20..21): mod_base = OTHER; note = 2 prime-O-methyl nucleosides
tgtccatttcatcacaaatca

SEQ ID NO: 1240 - RNA, 21 nt, synthetic construct
  source 1..21: mol_type = other RNA
  modified_base order(1..3,>21): mod_base = OTHER; note = phosphorothioate linkages
  modified_base order(1..8,13..21): mod_base = OTHER; note = 2 prime-O-methyl nucleosides
  modified_base 9..12: mod_base = OTHER; note = 2 prime-fluoro nucleosides
tgtccatttcatcacaaatca

SEQ ID NO: 1241 - RNA, 21 nt, synthetic construct
  source 1..21: mol_type = other RNA
  modified_base order(1..8,14..18,20..21): mod_base = OTHER; note = 2 prime-O-methyl nucleosides
tccatttcatcacaaatccca

SEQ ID NO: 1242 - RNA, 21 nt, synthetic construct
  source 1..21: mol_type = other RNA
  modified_base order(1..8,14..18,20..21): mod_base = OTHER; note = 2 prime-O-methyl nucleosides
tcatcacaaatcccttgtcaa

SEQ ID NO: 1243 - RNA, 21 nt, synthetic construct
  source 1..21: mol_type = other RNA
  modified_base order(1..8,14..18,20..21): mod_base = OTHER; note = 2 prime-O-methyl nucleosides
atcacaaatcccttgtcataa

SEQ ID NO: 1244 - RNA, 21 nt, synthetic construct
  source 1..21: mol_type = other RNA
  modified_base order(1..8,14..18,20..21): mod_base = OTHER; note = 2 prime-O-methyl nucleosides
tcacaaatcccttgtcataca

SEQ ID NO: 1245 - RNA, 21 nt, synthetic construct
  source 1..21: mol_type = other RNA
  modified_base order(1..3,>21): mod_base = OTHER; note = phosphorothioate linkages
  modified_base order(1..8,13..21): mod_base = OTHER; note = 2 prime-O-methyl nucleosides
  modified_base 9..12: mod_base = OTHER; note = 2 prime-fluoro nucleosides
tcacaaatcccttgtcataca

SEQ ID NO: 1246 - RNA, 21 nt, synthetic construct
  source 1..21: mol_type = other RNA
  modified_base order(1..8,14..18,20..21): mod_base = OTHER; note = 2 prime-O-methyl nucleosides
cacaaatcccttgtcatacca

SEQ ID NO: 1247 - RNA, 21 nt, synthetic construct
  source 1..21: mol_type = other RNA
  modified_base order(1..8,14..18,20..21): mod_base = OTHER; note = 2 prime-O-methyl nucleosides
acaaatcccttgtcataccaa

SEQ ID NO: 1248 - RNA, 21 nt, synthetic construct
  source 1..21: mol_type = other RNA
  modified_base order(1..8,14..18,20..21): mod_base = OTHER; note = 2 prime-O-methyl nucleosides
atcccttgtcataccataaga

SEQ ID NO: 1249 - RNA, 21 nt, synthetic construct
  source 1..21: mol_type = other RNA
  modified_base order(1..8,14..18,20..21): mod_base = OTHER; note = 2 prime-O-methyl nucleosides
tcccttgtcataccataagga

SEQ ID NO: 1250 - RNA, 21 nt, synthetic construct
  source 1..21: mol_type = other RNA
  modified_base order(1..8,14..18,20..21): mod_base = OTHER; note = 2 prime-O-methyl nucleosides
cccttgtcataccataaggta

SEQ ID NO: 1251 - RNA, 21 nt, synthetic construct
  source 1..21: mol_type = other RNA
  modified_base order(1..8,14..18,20..21): mod_base = OTHER; note = 2 prime-O-methyl nucleosides
ccttgtcataccataaggtga

SEQ ID NO: 1252 - RNA, 21 nt, synthetic construct
  source 1..21: mol_type = other RNA
  modified_base order(1..8,14..18,20..21): mod_base = OTHER; note = 2 prime-O-methyl nucleosides
cttgtcataccataaggtgta

SEQ ID NO: 1253 - RNA, 21 nt, synthetic construct
  source 1..21: mol_type = other RNA
  modified_base order(1..8,14..18,20..21): mod_base = OTHER; note = 2 prime-O-methyl nucleosides
tgtcataccataaggtgttga

SEQ ID NO: 1254 - RNA, 21 nt, synthetic construct
  source 1..21: mol_type = other RNA
  modified_base order(1..8,14..18,20..21): mod_base = OTHER; note = 2 prime-O-methyl nucleosides
ataccataaggtgttgtgcca

SEQ ID NO: 1255 - RNA, 21 nt, synthetic construct
  source 1..21: mol_type = other RNA
  modified_base order(1..8,14..18,20..21): mod_base = OTHER; note = 2 prime-O-methyl nucleosides
aaaaatttcactttgctacta

SEQ ID NO: 1256 - RNA, 21 nt, synthetic construct
  source 1..21: mol_type = other RNA
  modified_base order(1..8,14..18,20..21): mod_base = OTHER; note = 2 prime-O-methyl nucleosides
aatttcactttgctacttcta

SEQ ID NO: 1257 - RNA, 21 nt, synthetic construct
  source 1..21: mol_type = other RNA
  modified_base order(1..8,14..18,20..21): mod_base = OTHER; note = 2 prime-O-methyl nucleosides
ttgctacttctgcgaaggcaa

SEQ ID NO: 1258 - RNA, 21 nt, synthetic construct
  source 1..21: mol_type = other RNA
  modified_base order(1..8,14..18,20..21): mod_base = OTHER; note = 2 prime-O-methyl nucleosides
ctacttctgcgaaggcattta

SEQ ID NO: 1259 - RNA, 21 nt, synthetic construct
  source 1..21: mol_type = other RNA
  modified_base order(1..8,14..18,20..21): mod_base = OTHER; note = 2 prime-O-methyl nucleosides
acttctgcgaaggcatttgga

SEQ ID NO: 1260 - RNA, 21 nt, synthetic construct
  source 1..21: mol_type = other RNA
  modified_base order(1..8,14..18,20..21): mod_base = OTHER; note = 2 prime-O-methyl nucleosides
catttgggcacagaagcatta

SEQ ID NO: 1261 - RNA, 21 nt, synthetic construct
  source 1..21: mol_type = other RNA
  modified_base order(1..8,14..18,20..21): mod_base = OTHER; note = 2 prime-O-methyl nucleosides
tttgggcacagaagcattgaa

SEQ ID NO: 1262 - RNA, 21 nt, synthetic construct
  source 1..21: mol_type = other RNA
  modified_base order(1..8,14..18,20..21): mod_base = OTHER; note = 2 prime-O-methyl nucleosides
tgggcacagaagcattgacca

SEQ ID NO: 1263 - RNA, 21 nt, synthetic construct
  source 1..21: mol_type = other RNA
  modified_base order(1..8,14..18,20..21): mod_base = OTHER; note = 2 prime-O-methyl nucleosides
atgccttgaattccctcacga

SEQ ID NO: 1264 - RNA, 21 nt, synthetic construct
  source 1..21: mol_type = other RNA
  modified_base order(1..8,14..18,20..21): mod_base = OTHER; note = 2 prime-O-methyl nucleosides
tgccttgaattccctcacgga

SEQ ID NO: 1265 - RNA, 21 nt, synthetic construct
  source 1..21: mol_type = other RNA
  modified_base order(1..8,14..18,20..21): mod_base = OTHER; note = 2 prime-O-methyl nucleosides
gccttgaattccctcacggaa

SEQ ID NO: 1266 - RNA, 21 nt, synthetic construct
  source 1..21: mol_type = other RNA
  modified_base order(1..3,>21): mod_base = OTHER; note = phosphorothioate linkages
  modified_base order(1..8,13..21): mod_base = OTHER; note = 2 prime-O-methyl nucleosides
  modified_base 9..12: mod_base = OTHER; note = 2 prime-fluoro nucleosides
ccttgaattccctcacggaaa

SEQ ID NO: 1267 - RNA, 21 nt, synthetic construct
  source 1..21: mol_type = other RNA
  modified_base order(1..8,14..18,20..21): mod_base = OTHER; note = 2 prime-O-methyl nucleosides
ccttgaattccctcacggaaa

SEQ ID NO: 1268 - RNA, 21 nt, synthetic construct
  source 1..21: mol_type = other RNA
  modified_base order(1..8,14..18,20..21): mod_base = OTHER; note = 2 prime-O-methyl nucleosides
cttgaattccctcacggaaaa

SEQ ID NO: 1269 - RNA, 21 nt, synthetic construct
  source 1..21: mol_type = other RNA
  modified_base order(1..8,14..18,20..21): mod_base = OTHER; note = 2 prime-O-methyl nucleosides
aattccctcacggaaagcata

SEQ ID NO: 1270 - RNA, 21 nt, synthetic construct
  source 1..21: mol_type = other RNA
  modified_base order(1..8,14..18,20..21): mod_base = OTHER; note = 2 prime-O-methyl nucleosides
ttccctcacggaaagcatgaa

SEQ ID NO: 1271 - RNA, 21 nt, synthetic construct
  source 1..21: mol_type = other RNA
  modified_base order(1..8,14..18,20..21): mod_base = OTHER; note = 2 prime-O-methyl nucleosides
ccctcacggaaagcatgatga

SEQ ID NO: 1272 - RNA, 21 nt, synthetic construct
  source 1..21: mol_type = other RNA
  modified_base order(1..8,14..18,20..21): mod_base = OTHER; note = 2 prime-O-methyl nucleosides
ctcacggaaagcatgatggaa

SEQ ID NO: 1273 - RNA, 21 nt, synthetic construct
  source 1..21: mol_type = other RNA
  modified_base order(1..8,14..18,20..21): mod_base = OTHER; note = 2 prime-O-methyl nucleosides
tgatggaaaacctccaacgta

SEQ ID NO: 1274 - RNA, 21 nt, synthetic construct
  source 1..21: mol_type = other RNA
  modified_base order(1..8,14..18,20..21): mod_base = OTHER; note = 2 prime-O-methyl nucleosides
atggaaaacctccaacgtata

SEQ ID NO: 1275 - RNA, 21 nt, synthetic construct
  source 1..21: mol_type = other RNA
  modified_base order(1..8,14..18,20..21): mod_base = OTHER; note = 2 prime-O-methyl nucleosides
ggaaaacctccaacgtatcaa

SEQ ID NO: 1276 - RNA, 21 nt, synthetic construct
  source 1..21: mol_type = other RNA
  modified_base order(1..8,14..18,20..21): mod_base = OTHER; note = 2 prime-O-methyl nucleosides
gaaaacctccaacgtatcata

SEQ ID NO: 1277 - RNA, 21 nt, synthetic construct
  source 1..21: mol_type = other RNA
  modified_base order(1..3,>21): mod_base = OTHER; note = phosphorothioate linkages
  modified_base order(1..8,13..21): mod_base = OTHER; note = 2 prime-O-methyl nucleosides
  modified_base 9..12: mod_base = OTHER; note = 2 prime-fluoro nucleosides
gaaaacctccaacgtatcata

SEQ ID NO: 1278 - RNA, 21 nt, synthetic construct
  source 1..21: mol_type = other RNA
  modified_base order(1..8,14..18,20..21): mod_base = OTHER; note = 2 prime-O-methyl nucleosides
aaaacctccaacgtatcatga

SEQ ID NO: 1279 - RNA, 21 nt, synthetic construct
  source 1..21: mol_type = other RNA
  modified_base order(1..8,14..18,20..21): mod_base = OTHER; note = 2 prime-O-methyl nucleosides
aacctccaacgtatcatgaga

SEQ ID NO: 1280 - RNA, 21 nt, synthetic construct
  source 1..21: mol_type = other RNA
  modified_base order(1..8,14..18,20..21): mod_base = OTHER; note = 2 prime-O-methyl nucleosides
acctccaacgtatcatgagaa

SEQ ID NO: 1281 - RNA, 21 nt, synthetic construct
  source 1..21: mol_type = other RNA
  modified_base order(1..8,14..18,20..21): mod_base = OTHER; note = 2 prime-O-methyl nucleosides
cctccaacgtatcatgagaca

SEQ ID NO: 1282 - RNA, 21 nt, synthetic construct
  source 1..21: mol_type = other RNA
  modified_base order(1..8,14..18,20..21): mod_base = OTHER; note = 2 prime-O-methyl nucleosides
ctccaacgtatcatgagacca

SEQ ID NO: 1283 - RNA, 21 nt, synthetic construct
  source 1..21: mol_type = other RNA
  modified_base order(1..8,14..18,20..21): mod_base = OTHER; note = 2 prime-O-methyl nucleosides
tccaacgtatcatgagaccta

SEQ ID NO: 1284 - RNA, 21 nt, synthetic construct
  source 1..21: mol_type = other RNA
  modified_base order(1..8,14..18,20..21): mod_base = OTHER; note = 2 prime-O-methyl nucleosides
ccaacgtatcatgagacctca

SEQ ID NO: 1285 - RNA, 21 nt, synthetic construct
  source 1..21: mol_type = other RNA
  modified_base order(1..8,14..18,20..21): mod_base = OTHER; note = 2 prime-O-methyl nucleosides
tcctctaactcaaagaccgca

SEQ ID NO: 1286 - RNA, 21 nt, synthetic construct
  source 1..21: mol_type = other RNA
  modified_base order(1..8,14..18,20..21): mod_base = OTHER; note = 2 prime-O-methyl nucleosides
agaccgctgcctgggtgacaa

SEQ ID NO: 1287 - RNA, 21 nt, synthetic construct
  source 1..21: mol_type = other RNA
  modified_base order(1..8,14..18,20..21): mod_base = OTHER; note = 2 prime-O-methyl nucleosides
ctgggtgacagaagggatgta

SEQ ID NO: 1288 - RNA, 21 nt, synthetic construct
  source 1..21: mol_type = other RNA
  modified_base order(1..8,14..18,20..21): mod_base = OTHER; note = 2 prime-O-methyl nucleosides
tgggtgacagaagggatgtaa

SEQ ID NO: 1289 - RNA, 21 nt, synthetic construct
  source 1..21: mol_type = other RNA
  modified_base order(1..8,14..18,20..21): mod_base = OTHER; note = 2 prime-O-methyl nucleosides
gggtgacagaagggatgtata

SEQ ID NO: 1290 - RNA, 21 nt, synthetic construct
  source 1..21: mol_type = other RNA
  modified_base order(1..8,14..18,20..21): mod_base = OTHER; note = 2 prime-O-methyl nucleosides
ctttctgctaccgagtgatga

SEQ ID NO: 1291 - RNA, 21 nt, synthetic construct
  source 1..21: mol_type = other RNA
  modified_base order(1..8,14..18,20..21): mod_base = OTHER; note = 2 prime-O-methyl nucleosides
ttctgctaccgagtgatgtta

SEQ ID NO: 1292 - RNA, 21 nt, synthetic construct
  source 1..21: mol_type = other RNA
  modified_base order(1..8,14..18,20..21): mod_base = OTHER; note = 2 prime-O-methyl nucleosides
tctgctaccgagtgatgttta

SEQ ID NO: 1293 - RNA, 21 nt, synthetic construct
  source 1..21: mol_type = other RNA
  modified_base order(1..8,14..18,20..21): mod_base = OTHER; note = 2 prime-O-methyl nucleosides
ctgctaccgagtgatgtttga

SEQ ID NO: 1294 - RNA, 21 nt, synthetic construct
  source 1..21: mol_type = other RNA
  modified_base order(1..8,14..18,20..21): mod_base = OTHER; note = 2 prime-O-methyl nucleosides
taccgagtgatgtttgaagca

SEQ ID NO: 1295 - RNA, 21 nt, synthetic construct
  source 1..21: mol_type = other RNA
  modified_base order(1..8,14..18,20..21): mod_base = OTHER; note = 2 prime-O-methyl nucleosides
accgagtgatgtttgaagcta

SEQ ID NO: 1296 - RNA, 21 nt, synthetic construct
  source 1..21: mol_type = other RNA
  modified_base order(1..8,14..18,20..21): mod_base = OTHER; note = 2 prime-O-methyl nucleosides
ccgagtgatgtttgaagctga

SEQ ID NO: 1297 - RNA, 21 nt, synthetic construct
  source 1..21: mol_type = other RNA
  modified_base order(1..8,14..18,20..21): mod_base = OTHER; note = 2 prime-O-methyl nucleosides
atgtttgaagctgggtattta

SEQ ID NO: 1298 - RNA, 21 nt, synthetic construct
  source 1..21: mol_type = other RNA
  modified_base order(1..3,>21): mod_base = OTHER; note = phosphorothioate linkages
  modified_base order(1..8,13..21): mod_base = OTHER; note = 2 prime-O-methyl nucleosides
  modified_base 9..12: mod_base = OTHER; note = 2 prime-fluoro nucleosides
atgtttgaagctgggtattta

SEQ ID NO: 1299 - RNA, 21 nt, synthetic construct
  source 1..21: mol_type = other RNA
  modified_base order(1..8,14..18,20..21): mod_base = OTHER; note = 2 prime-O-methyl nucleosides
tttgaagctgggtatttaaca

SEQ ID NO: 1300 - RNA, 21 nt, synthetic construct
  source 1..21: mol_type = other RNA
  modified_base order(1..8,14..18,20..21): mod_base = OTHER; note = 2 prime-O-methyl nucleosides
ttgaagctgggtatttaacta

SEQ ID NO: 1301 - RNA, 21 nt, synthetic construct
  source 1..21: mol_type = other RNA
  modified_base order(1..8,14..18,20..21): mod_base = OTHER; note = 2 prime-O-methyl nucleosides
tgaagctgggtatttaactaa

SEQ ID NO: 1302 - RNA, 21 nt, synthetic construct
  source 1..21: mol_type = other RNA
  modified_base order(1..8,14..18,20..21): mod_base = OTHER; note = 2 prime-O-methyl nucleosides
gaagctgggtatttaactata

SEQ ID NO: 1303 - RNA, 21 nt, synthetic construct
  source 1..21: mol_type = other RNA
  modified_base order(1..8,14..18,20..21): mod_base = OTHER; note = 2 prime-O-methyl nucleosides
aagctgggtatttaactatca

SEQ ID NO: 1304 - RNA, 21 nt, synthetic construct
  source 1..21: mol_type = other RNA
  modified_base order(1..8,14..18,20..21): mod_base = OTHER; note = 2 prime-O-methyl nucleosides
agctgggtatttaactatcta

SEQ ID NO: 1305 - RNA, 21 nt, synthetic construct
  source 1..21: mol_type = other RNA
  modified_base order(1..8,14..18,20..21): mod_base = OTHER; note = 2 prime-O-methyl nucleosides
ctgggtatttaactatcttta

SEQ ID NO: 1306 - RNA, 21 nt, synthetic construct
  source 1..21: mol_type = other RNA
  modified_base order(1..8,14..18,20..21): mod_base = OTHER; note = 2 prime-O-methyl nucleosides
tgggtatttaactatctttga

SEQ ID NO: 1307 - RNA, 21 nt, synthetic construct
  source 1..21: mol_type = other RNA
  modified_base order(1..8,14..18,20..21): mod_base = OTHER; note = 2 prime-O-methyl nucleosides
gacacacagaaagcacatata

SEQ ID NO: 1308 - RNA, 21 nt, synthetic construct
  source 1..21: mol_type = other RNA
  modified_base order(1..8,14..18,20..21): mod_base = OTHER; note = 2 prime-O-methyl nucleosides
aagcacatattctaaacaata

SEQ ID NO: 1309 - RNA, 21 nt, synthetic construct
  source 1..21: mol_type = other RNA
  modified_base order(1..8,14..18,20..21): mod_base = OTHER; note = 2 prime-O-methyl nucleosides
gcacatattctaaacaatcta

SEQ ID NO: 1310 - RNA, 21 nt, synthetic construct
  source 1..21: mol_type = other RNA
  modified_base order(1..8,14..18,20..21): mod_base = OTHER; note = 2 prime-O-methyl nucleosides
cacatattctaaacaatctta

SEQ ID NO: 1311 - RNA, 21 nt, synthetic construct
  source 1..21: mol_type = other RNA
  modified_base order(1..8,14..18,20..21): mod_base = OTHER; note = 2 prime-O-methyl nucleosides
acatattctaaacaatcttga

SEQ ID NO: 1312 - RNA, 21 nt, synthetic construct
  source 1..21: mol_type = other RNA
  modified_base order(1..8,14..18,20..21): mod_base = OTHER; note = 2 prime-O-methyl nucleosides
atattctaaacaatcttgaca

SEQ ID NO: 1313 - RNA, 21 nt, synthetic construct
  source 1..21: mol_type = other RNA
  modified_base order(1..8,14..18,20..21): mod_base = OTHER; note = 2 prime-O-methyl nucleosides
tattctaaacaatcttgacaa

SEQ ID NO: 1314 - RNA, 21 nt, synthetic construct
  source 1..21: mol_type = other RNA
  modified_base order(1..8,14..18,20..21): mod_base = OTHER; note = 2 prime-O-methyl nucleosides
attctaaacaatcttgacaaa

SEQ ID NO: 1315 - RNA, 21 nt, synthetic construct
  source 1..21: mol_type = other RNA
  modified_base order(1..8,14..18,20..21): mod_base = OTHER; note = 2 prime-O-methyl nucleosides
tctaaacaatcttgacaacta

SEQ ID NO: 1316 - RNA, 21 nt, synthetic construct
  source 1..21: mol_type = other RNA
  modified_base order(1..8,14..18,20..21): mod_base = OTHER; note = 2 prime-O-methyl nucleosides
caatcttgacaacttcaagca

SEQ ID NO: 1317 - RNA, 21 nt, synthetic construct
  source 1..21: mol_type = other RNA
  modified_base order(1..8,14..18,20..21): mod_base = OTHER; note = 2 prime-O-methyl nucleosides
ctttccagccctggtagcaga

SEQ ID NO: 1318 - RNA, 21 nt, synthetic construct
  source 1..21: mol_type = other RNA
  modified_base order(1..8,14..18,20..21): mod_base = OTHER; note = 2 prime-O-methyl nucleosides
gggagaaactggcagagagca

SEQ ID NO: 1319 - RNA, 21 nt, synthetic construct
  source 1..21: mol_type = other RNA
  modified_base order(1..8,14..18,20..21): mod_base = OTHER; note = 2 prime-O-methyl nucleosides
ggcagagagcttgaggcacga

SEQ ID NO: 1320 - RNA, 21 nt, synthetic construct
  source 1..21: mol_type = other RNA
  modified_base order(1..8,14..18,20..21): mod_base = OTHER; note = 2 prime-O-methyl nucleosides
agcttgaggcacgagaaccta

SEQ ID NO: 1321 - RNA, 21 nt, synthetic construct
  source 1..21: mol_type = other RNA
  modified_base order(1..8,14..18,20..21): mod_base = OTHER; note = 2 prime-O-methyl nucleosides
cctgcgcatgtttctcaatga

SEQ ID NO: 1322 - RNA, 21 nt, synthetic construct
  source 1..21: mol_type = other RNA
  modified_base order(1..8,14..18,20..21): mod_base = OTHER; note = 2 prime-O-methyl nucleosides
gcgcatgtttctcaatgacaa

SEQ ID NO: 1323 - RNA, 21 nt, synthetic construct
  source 1..21: mol_type = other RNA
  modified_base order(1..3,>21): mod_base = OTHER; note = phosphorothioate linkages
  modified_base order(1..8,13..21): mod_base = OTHER; note = 2 prime-O-methyl nucleosides
  modified_base 9..12: mod_base = OTHER; note = 2 prime-fluoro nucleosides
gcgcatgtttctcaatgacaa

SEQ ID NO: 1324 - RNA, 21 nt, synthetic construct
  source 1..21: mol_type = other RNA
  modified_base order(1..8,14..18,20..21): mod_base = OTHER; note = 2 prime-O-methyl nucleosides
gcatgtttctcaatgacacta

SEQ ID NO: 1325 - RNA, 21 nt, synthetic construct
  source 1..21: mol_type = other RNA
  modified_base order(1..8,14..18,20..21): mod_base = OTHER; note = 2 prime-O-methyl nucleosides
gtttctcaatgacactttgta

SEQ ID NO: 1326 - RNA, 21 nt, synthetic construct
  source 1..21: mol_type = other RNA
  modified_base order(1..8,14..18,20..21): mod_base = OTHER; note = 2 prime-O-methyl nucleosides
tttctcaatgacactttgtca

SEQ ID NO: 1327 - RNA, 21 nt, synthetic construct
  source 1..21: mol_type = other RNA
  modified_base order(1..8,14..18,20..21): mod_base = OTHER; note = 2 prime-O-methyl nucleosides
ttctcaatgacactttgtcca

SEQ ID NO: 1328 - RNA, 21 nt, synthetic construct
  source 1..21: mol_type = other RNA
  modified_base order(1..8,14..18,20..21): mod_base = OTHER; note = 2 prime-O-methyl nucleosides
acactttgtccacctttgata

SEQ ID NO: 1329 - RNA, 21 nt, synthetic construct
  source 1..21: mol_type = other RNA
  modified_base order(1..8,14..18,20..21): mod_base = OTHER; note = 2 prime-O-methyl nucleosides
cactttgtccacctttgatga

SEQ ID NO: 1330 - RNA, 21 nt, synthetic construct
  source 1..21: mol_type = other RNA
  modified_base order(1..8,14..18,20..21): mod_base = OTHER; note = 2 prime-O-methyl nucleosides
acacctcgtggtcctctggga

SEQ ID NO: 1331 - RNA, 21 nt, synthetic construct
  source 1..21: mol_type = other RNA
  modified_base order(1..8,14..18,20..21): mod_base = OTHER; note = 2 prime-O-methyl nucleosides
acctcgtggtcctctgggcaa

SEQ ID NO: 1332 - RNA, 21 nt, synthetic construct
  source 1..21: mol_type = other RNA
  modified_base order(1..8,14..18,20..21): mod_base = OTHER; note = 2 prime-O-methyl nucleosides
cctcgtggtcctctgggcata

SEQ ID NO: 1333 - RNA, 21 nt, synthetic construct
  source 1..21: mol_type = other RNA
  modified_base order(1..8,14..18,20..21): mod_base = OTHER; note = 2 prime-O-methyl nucleosides
ctcgtggtcctctgggcatca

SEQ ID NO: 1334 - RNA, 21 nt, synthetic construct
  source 1..21: mol_type = other RNA
  modified_base order(1..8,14..18,20..21): mod_base = OTHER; note = 2 prime-O-methyl nucleosides
tcgtggtcctctgggcatcga

SEQ ID NO: 1335 - RNA, 21 nt, synthetic construct
  source 1..21: mol_type = other RNA
  modified_base order(1..8,14..18,20..21): mod_base = OTHER; note = 2 prime-O-methyl nucleosides
tcctctgggcatcgcaagcaa

SEQ ID NO: 1336 - RNA, 21 nt, synthetic construct
  source 1..21: mol_type = other RNA
  modified_base order(1..8,14..18,20..21): mod_base = OTHER; note = 2 prime-O-methyl nucleosides
tctgggcatcgcaagcaaaca

SEQ ID NO: 1337 - RNA, 21 nt, synthetic construct
  source 1..21: mol_type = other RNA
  modified_base order(1..8,14..18,20..21): mod_base = OTHER; note = 2 prime-O-methyl nucleosides
ctgggcatcgcaagcaaacaa

SEQ ID NO: 1338 - RNA, 21 nt, synthetic construct
  source 1..21: mol_type = other RNA
  modified_base order(1..8,14..18,20..21): mod_base = OTHER; note = 2 prime-O-methyl nucleosides
tgggcatcgcaagcaaacaca

SEQ ID NO: 1339 - RNA, 21 nt, synthetic construct
  source 1..21: mol_type = other RNA
  modified_base order(1..8,14..18,20..21): mod_base = OTHER; note = 2 prime-O-methyl nucleosides
gcatcgcaagcaaacaccata

SEQ ID NO: 1340 - RNA, 21 nt, synthetic construct
  source 1..21: mol_type = other RNA
  modified_base order(1..8,14..18,20..21): mod_base = OTHER; note = 2 prime-O-methyl nucleosides
catcgcaagcaaacaccatta

SEQ ID NO: 1341 - RNA, 21 nt, synthetic construct
  source 1..21: mol_type = other RNA
  modified_base order(1..8,14..18,20..21): mod_base = OTHER; note = 2 prime-O-methyl nucleosides
ttctggagtttatttcaaata

SEQ ID NO: 1342 - RNA, 21 nt, synthetic construct
  source 1..21: mol_type = other RNA
  modified_base order(1..8,14..18,20..21): mod_base = OTHER; note = 2 prime-O-methyl nucleosides
ggagtttatttcaaatgatta

SEQ ID NO: 1343 - RNA, 21 nt, synthetic construct
  source 1..21: mol_type = other RNA
  modified_base order(1..8,14..18,20..21): mod_base = OTHER; note = 2 prime-O-methyl nucleosides
gagtttatttcaaatgattaa

SEQ ID NO: 1344 - RNA, 21 nt, synthetic construct
  source 1..21: mol_type = other RNA
  modified_base order(1..8,14..18,20..21): mod_base = OTHER; note = 2 prime-O-methyl nucleosides
agtttatttcaaatgattaga

SEQ ID NO: 1345 - RNA, 21 nt, synthetic construct
  source 1..21: mol_type = other RNA
  modified_base order(1..8,14..18,20..21): mod_base = OTHER; note = 2 prime-O-methyl nucleosides
gtttatttcaaatgattagga

SEQ ID NO: 1346 - RNA, 21 nt, synthetic construct
  source 1..21: mol_type = other RNA
  modified_base order(1..8,14..18,20..21): mod_base = OTHER; note = 2 prime-O-methyl nucleosides
ccagaagcaatgaaagcagca

SEQ ID NO: 1347 - RNA, 21 nt, synthetic construct
  source 1..21: mol_type = other RNA
  modified_base order(1..8,14..18,20..21): mod_base = OTHER; note = 2 prime-O-methyl nucleosides
agaagcaatgaaagcagctaa

SEQ ID NO: 1348 - RNA, 21 nt, synthetic construct
  source 1..21: mol_type = other RNA
  modified_base order(1..8,14..18,20..21): mod_base = OTHER; note = 2 prime-O-methyl nucleosides
gaagcaatgaaagcagctaca

SEQ ID NO: 1349 - RNA, 21 nt, synthetic construct
  source 1..21: mol_type = other RNA
  modified_base order(1..8,14..18,20..21): mod_base = OTHER; note = 2 prime-O-methyl nucleosides
aatgaaagcagctactgaaga

SEQ ID NO: 1350 - RNA, 21 nt, synthetic construct
  source 1..21: mol_type = other RNA
  modified_base order(1..8,14..18,20..21): mod_base = OTHER; note = 2 prime-O-methyl nucleosides
atgaaagcagctactgaagaa

SEQ ID NO: 1351 - RNA, 21 nt, synthetic construct
  source 1..21: mol_type = other RNA
  modified_base order(1..8,14..18,20..21): mod_base = OTHER; note = 2 prime-O-methyl nucleosides
aaagcagctactgaagaagta

SEQ ID NO: 1352 - RNA, 21 nt, synthetic construct
  source 1..21: mol_type = other RNA
  modified_base order(1..8,14..18,20..21): mod_base = OTHER; note = 2 prime-O-methyl nucleosides
aagcagctactgaagaagtga

SEQ ID NO: 1353 - RNA, 21 nt, synthetic construct
  source 1..21: mol_type = other RNA
  modified_base order(1..8,14..18,20..21): mod_base = OTHER; note = 2 prime-O-methyl nucleosides
agcagctactgaagaagtgaa

SEQ ID NO: 1354 - RNA, 21 nt, synthetic construct
  source 1..21: mol_type = other RNA
  modified_base order(1..8,14..18,20..21): mod_base = OTHER; note = 2 prime-O-methyl nucleosides
gcagctactgaagaagtgaaa

SEQ ID NO: 1355 - RNA, 21 nt, synthetic construct
  source 1..21: mol_type = other RNA
  modified_base order(1..8,14..18,20..21): mod_base = OTHER; note = 2 prime-O-methyl nucleosides
cagctactgaagaagtgaaaa

SEQ ID NO: 1356 - RNA, 21 nt, synthetic construct
  source 1..21: mol_type = other RNA
  modified_base order(1..8,14..18,20..21): mod_base = OTHER; note = 2 prime-O-methyl nucleosides
aagaagtgaaaagaacattaa

SEQ ID NO: 1357 - RNA, 21 nt, synthetic construct
  source 1..21: mol_type = other RNA
  modified_base order(1..8,14..18,20..21): mod_base = OTHER; note = 2 prime-O-methyl nucleosides
agaagtgaaaagaacattaga

SEQ ID NO: 1358 - RNA, 21 nt, synthetic construct
  source 1..21: mol_type = other RNA
  modified_base order(1..8,14..18,20..21): mod_base = OTHER; note = 2 prime-O-methyl nucleosides
gaagtgaaaagaacattagaa

SEQ ID NO: 1359 - RNA, 21 nt, synthetic construct
  source 1..21: mol_type = other RNA
  modified_base order(1..8,14..18,20..21): mod_base = OTHER; note = 2 prime-O-methyl nucleosides
tgaaaagaacattagagaata

SEQ ID NO: 1360 - RNA, 21 nt, synthetic construct
  source 1..21: mol_type = other RNA
  modified_base order(1..8,14..18,20..21): mod_base = OTHER; note = 2 prime-O-methyl nucleosides
gaaaagaacattagagaatga

SEQ ID NO: 1361 - RNA, 21 nt, synthetic construct
  source 1..21: mol_type = other RNA
  modified_base order(1..8,14..18,20..21): mod_base = OTHER; note = 2 prime-O-methyl nucleosides
aaaagaacattagagaatgca

SEQ ID NO: 1362 - RNA, 21 nt, synthetic construct
  source 1..21: mol_type = other RNA
  modified_base order(1..8,14..18,20..21): mod_base = OTHER; note = 2 prime-O-methyl nucleosides
aacattagagaatgctggtca

SEQ ID NO: 1363 - RNA, 21 nt, synthetic construct
  source 1..21: mol_type = other RNA
  modified_base order(1..8,14..18,20..21): mod_base = OTHER; note = 2 prime-O-methyl nucleosides
acattagagaatgctggtcaa

SEQ ID NO: 1364 - RNA, 21 nt, synthetic construct
  source 1..21: mol_type = other RNA
  modified_base order(1..8,14..18,20..21): mod_base = OTHER; note = 2 prime-O-methyl nucleosides
cattagagaatgctggtcaaa

SEQ ID NO: 1365 - RNA, 21 nt, synthetic construct
  source 1..21: mol_type = other RNA
  modified_base order(1..8,14..18,20..21): mod_base = OTHER; note = 2 prime-O-methyl nucleosides
attagagaatgctggtcaaaa

SEQ ID NO: 1366 - RNA, 21 nt, synthetic construct
  source 1..21: mol_type = other RNA
  modified_base order(1..8,14..18,20..21): mod_base = OTHER; note = 2 prime-O-methyl nucleosides
agaatgctggtcaaaaagtca

SEQ ID NO: 1367 - RNA, 21 nt, synthetic construct
  source 1..21: mol_type = other RNA
  modified_base order(1..8,14..18,20..21): mod_base = OTHER; note = 2 prime-O-methyl nucleosides
gaatgctggtcaaaaagtcaa

SEQ ID NO: 1368 - RNA, 21 nt, synthetic construct
  source 1..21: mol_type = other RNA
  modified_base order(1..8,14..18,20..21): mod_base = OTHER; note = 2 prime-O-methyl nucleosides
atgctggtcaaaaagtcagca

SEQ ID NO: 1369 - RNA, 21 nt, synthetic construct
  source 1..21: mol_type = other RNA
  modified_base order(1..8,14..18,20..21): mod_base = OTHER; note = 2 prime-O-methyl nucleosides
tcaaaaagtcagcttggaaga

SEQ ID NO: 1370 - RNA, 21 nt, synthetic construct
  source 1..21: mol_type = other RNA
  modified_base order(1..8,14..18,20..21): mod_base = OTHER; note = 2 prime-O-methyl nucleosides
aaaagtcagcttggaaggcaa

SEQ ID NO: 1371 - RNA, 21 nt, synthetic construct
  source 1..21: mol_type = other RNA
  modified_base order(1..8,14..18,20..21): mod_base = OTHER; note = 2 prime-O-methyl nucleosides
agtcagcttggaaggcaatca

SEQ ID NO: 1372 - RNA, 21 nt, synthetic construct
  source 1..21: mol_type = other RNA
  modified_base order(1..8,14..18,20..21): mod_base = OTHER; note = 2 prime-O-methyl nucleosides
actgaatgacctgccagtata

SEQ ID NO: 1373 - RNA, 21 nt, synthetic construct
  source 1..21: mol_type = other RNA
  modified_base order(1..3,>21): mod_base = OTHER; note = phosphorothioate linkages
  modified_base order(1..8,13..21): mod_base = OTHER; note = 2 prime-O-methyl nucleosides
  modified_base 9..12: mod_base = OTHER; note = 2 prime-fluoro nucleosides
actgaatgacctgccagtata

SEQ ID NO: 1374 - RNA, 21 nt, synthetic construct
  source 1..21: mol_type = other RNA
  modified_base order(1..8,14..18,20..21): mod_base = OTHER; note = 2 prime-O-methyl nucleosides
gaatgacctgccagtattaga

SEQ ID NO: 1375 - RNA, 21 nt, synthetic construct
  source 1..21: mol_type = other RNA
  modified_base order(1..8,14..18,20..21): mod_base = OTHER; note = 2 prime-O-methyl nucleosides
tttccagtgcctccctcaaca

SEQ ID NO: 1376 - RNA, 21 nt, synthetic construct
  source 1..21: mol_type = other RNA
  modified_base order(1..8,14..18,20..21): mod_base = OTHER; note = 2 prime-O-methyl nucleosides
aacatccggacagctaaggaa

SEQ ID NO: 1377 - RNA, 21 nt, synthetic construct
  source 1..21: mol_type = other RNA
  modified_base order(1..8,14..18,20..21): mod_base = OTHER; note = 2 prime-O-methyl nucleosides
acatccggacagctaaggaga

SEQ ID NO: 1378 - RNA, 21 nt, synthetic construct
  source 1..21: mol_type = other RNA
  modified_base order(1..8,14..18,20..21): mod_base = OTHER; note = 2 prime-O-methyl nucleosides
tccggacagctaaggaggata

SEQ ID NO: 1379 - RNA, 21 nt, synthetic construct
  source 1..21: mol_type = other RNA
  modified_base order(1..8,14..18,20..21): mod_base = OTHER; note = 2 prime-O-methyl nucleosides
ggacagctaaggaggatttca

SEQ ID NO: 1380 - RNA, 21 nt, synthetic construct
  source 1..21: mol_type = other RNA
  modified_base order(1..8,14..18,20..21): mod_base = OTHER; note = 2 prime-O-methyl nucleosides
acagctaaggaggatttcaca

SEQ ID NO: 1381 - RNA, 21 nt, synthetic construct
  source 1..21: mol_type = other RNA
  modified_base order(1..8,14..18,20..21): mod_base = OTHER; note = 2 prime-O-methyl nucleosides
agctaaggaggatttcactta

SEQ ID NO: 1382 - RNA, 21 nt, synthetic construct
  source 1..21: mol_type = other RNA
  modified_base order(1..8,14..18,20..21): mod_base = OTHER; note = 2 prime-O-methyl nucleosides
taaggaggatttcactttgca

SEQ ID NO: 1383 - RNA, 21 nt, synthetic construct
  source 1..21: mol_type = other RNA
  modified_base order(1..8,14..18,20..21): mod_base = OTHER; note = 2 prime-O-methyl nucleosides
ggaggatttcactttgcacca

SEQ ID NO: 1384 - RNA, 21 nt, synthetic construct
  source 1..21: mol_type = other RNA
  modified_base order(1..8,14..18,20..21): mod_base = OTHER; note = 2 prime-O-methyl nucleosides
gaggatttcactttgcaccta

SEQ ID NO: 1385 - RNA, 21 nt, synthetic construct
  source 1..21: mol_type = other RNA
  modified_base order(1..8,14..18,20..21): mod_base = OTHER; note = 2 prime-O-methyl nucleosides
tttcactttgcaccttgagga

SEQ ID NO: 1386 - RNA, 21 nt, synthetic construct
  source 1..21: mol_type = other RNA
  modified_base order(1..8,14..18,20..21): mod_base = OTHER; note = 2 prime-O-methyl nucleosides
cactttgcaccttgaggacga

SEQ ID NO: 1387 - RNA, 21 nt, synthetic construct
  source 1..21: mol_type = other RNA
  modified_base order(1..8,14..18,20..21): mod_base = OTHER; note = 2 prime-O-methyl nucleosides
actttgcaccttgaggacgga

SEQ ID NO: 1388 - RNA, 21 nt, synthetic construct
  source 1..21: mol_type = other RNA
  modified_base order(1..8,14..18,20..21): mod_base = OTHER; note = 2 prime-O-methyl nucleosides
tgaggacggttcctacaacaa

SEQ ID NO: 1389 - RNA, 21 nt, synthetic construct
  source 1..21: mol_type = other RNA
  modified_base order(1..8,14..18,20..21): mod_base = OTHER; note = 2 prime-O-methyl nucleosides
aggacggttcctacaacatca

SEQ ID NO: 1390 - RNA, 21 nt, synthetic construct
  source 1..21: mol_type = other RNA
  modified_base order(1..8,14..18,20..21): mod_base = OTHER; note = 2 prime-O-methyl nucleosides
acggttcctacaacatccgaa

SEQ ID NO: 1391 - RNA, 21 nt, synthetic construct
  source 1..21: mol_type = other RNA
  modified_base order(1..8,14..18,20..21): mod_base = OTHER; note = 2 prime-O-methyl nucleosides
ggttcctacaacatccgaaaa

SEQ ID NO: 1392 - RNA, 21 nt, synthetic construct
  source 1..21: mol_type = other RNA
  modified_base order(1..8,14..18,20..21): mod_base = OTHER; note = 2 prime-O-methyl nucleosides
cctacaacatccgaaaagata

SEQ ID NO: 1393 - RNA, 21 nt, synthetic construct
  source 1..21: mol_type = other RNA
  modified_base order(1..8,14..18,20..21): mod_base = OTHER; note = 2 prime-O-methyl nucleosides
ctacaacatccgaaaagatga

SEQ ID NO: 1394 - RNA, 21 nt, synthetic construct
  source 1..21: mol_type = other RNA
  modified_base order(1..8,14..18,20..21): mod_base = OTHER; note = 2 prime-O-methyl nucleosides
acaacatccgaaaagatgaca

SEQ ID NO: 1395 - RNA, 21 nt, synthetic construct
  source 1..21: mol_type = other RNA
  modified_base order(1..8,14..18,20..21): mod_base = OTHER; note = 2 prime-O-methyl nucleosides
caacatccgaaaagatgacaa

SEQ ID NO: 1396 - RNA, 21 nt, synthetic construct
  source 1..21: mol_type = other RNA
  modified_base order(1..8,14..18,20..21): mod_base = OTHER; note = 2 prime-O-methyl nucleosides
aacatccgaaaagatgacata

SEQ ID NO: 1397 - RNA, 21 nt, synthetic construct
  source 1..21: mol_type = other RNA
  modified_base order(1..8,14..18,20..21): mod_base = OTHER; note = 2 prime-O-methyl nucleosides
catccgaaaagatgacatcaa

SEQ ID NO: 1398 - RNA, 21 nt, synthetic construct
  source 1..21: mol_type = other RNA
  modified_base order(1..8,14..18,20..21): mod_base = OTHER; note = 2 prime-O-methyl nucleosides
tccgaaaagatgacatcataa

SEQ ID NO: 1399 - RNA, 21 nt, synthetic construct
  source 1..21: mol_type = other RNA
  modified_base order(1..8,14..18,20..21): mod_base = OTHER; note = 2 prime-O-methyl nucleosides
gaaaagatgacatcatagcta

SEQ ID NO: 1400 - RNA, 21 nt, synthetic construct
  source 1..21: mol_type = other RNA
  modified_base order(1..8,14..18,20..21): mod_base = OTHER; note = 2 prime-O-methyl nucleosides
aaagatgacatcatagctcta

SEQ ID NO: 1401 - RNA, 21 nt, synthetic construct
  source 1..21: mol_type = other RNA
  modified_base order(1..8,14..18,20..21): mod_base = OTHER; note = 2 prime-O-methyl nucleosides
aagatgacatcatagctctta

SEQ ID NO: 1402 - RNA, 21 nt, synthetic construct
  source 1..21: mol_type = other RNA
  modified_base order(1..8,14..18,20..21): mod_base = OTHER; note = 2 prime-O-methyl nucleosides
gatgacatcatagctctttaa

SEQ ID NO: 1403 - RNA, 21 nt, synthetic construct
  source 1..21: mol_type = other RNA
  modified_base order(1..8,14..18,20..21): mod_base = OTHER; note = 2 prime-O-methyl nucleosides
atagctctttacccacagtta

SEQ ID NO: 1404 - RNA, 21 nt, synthetic construct
  source 1..21: mol_type = other RNA
  modified_base order(1..8,14..18,20..21): mod_base = OTHER; note = 2 prime-O-methyl nucleosides
tagctctttacccacagttaa

SEQ ID NO: 1405 - RNA, 21 nt, synthetic construct
  source 1..21: mol_type = other RNA
  modified_base order(1..3,>21): mod_base = OTHER; note = phosphorothioate linkages
  modified_base order(1..8,13..21): mod_base = OTHER; note = 2 prime-O-methyl nucleosides
  modified_base 9..12: mod_base = OTHER; note = 2 prime-fluoro nucleosides
tagctctttacccacagttaa

SEQ ID NO: 1406 - RNA, 21 nt, synthetic construct
  source 1..21: mol_type = other RNA
  modified_base order(1..3,>21): mod_base = OTHER; note = phosphorothioate linkages
  modified_base order(1..8,13..21): mod_base = OTHER; note = 2 prime-O-methyl nucleosides
  modified_base 9..12: mod_base = OTHER; note = 2 prime-fluoro nucleosides
agctctttacccacagttaaa

SEQ ID NO: 1407 - RNA, 21 nt, synthetic construct
  source 1..21: mol_type = other RNA
  modified_base order(1..8,14..18,20..21): mod_base = OTHER; note = 2 prime-O-methyl nucleosides
agctctttacccacagttaaa

SEQ ID NO: 1408 - RNA, 21 nt, synthetic construct
  source 1..21: mol_type = other RNA
  modified_base order(1..8,14..18,20..21): mod_base = OTHER; note = 2 prime-O-methyl nucleosides
gctctttacccacagttaata

SEQ ID NO: 1409 - RNA, 21 nt, synthetic construct
  source 1..21: mol_type = other RNA
  modified_base order(1..8,14..18,20..21): mod_base = OTHER; note = 2 prime-O-methyl nucleosides
ctctttacccacagttaatga

SEQ ID NO: 1410 - RNA, 21 nt, synthetic construct
  source 1..21: mol_type = other RNA
  modified_base order(1..8,14..18,20..21): mod_base = OTHER; note = 2 prime-O-methyl nucleosides
tctttacccacagttaatgca

SEQ ID NO: 1411 - RNA, 21 nt, synthetic construct
  source 1..21: mol_type = other RNA
  modified_base order(1..8,14..18,20..21): mod_base = OTHER; note = 2 prime-O-methyl nucleosides
tttacccacagttaatgcaca

SEQ ID NO: 1412 - RNA, 21 nt, synthetic construct
  source 1..21: mol_type = other RNA
  modified_base order(1..8,14..18,20..21): mod_base = OTHER; note = 2 prime-O-methyl nucleosides
acccacagttaatgcacttaa

SEQ ID NO: 1413 - RNA, 21 nt, synthetic construct
  source 1..21: mol_type = other RNA
  modified_base order(1..3,>21): mod_base = OTHER; note = phosphorothioate linkages
  modified_base order(1..8,13..21): mod_base = OTHER; note = 2 prime-O-methyl nucleosides
  modified_base 9..12: mod_base = OTHER; note = 2 prime-fluoro nucleosides
cccacagttaatgcacttaga

SEQ ID NO: 1414 - RNA, 21 nt, synthetic construct
  source 1..21: mol_type = other RNA
  modified_base order(1..8,14..18,20..21): mod_base = OTHER; note = 2 prime-O-methyl nucleosides
cccacagttaatgcacttaga

SEQ ID NO: 1415 - RNA, 21 nt, synthetic construct
  source 1..21: mol_type = other RNA
  modified_base order(1..8,14..18,20..21): mod_base = OTHER; note = 2 prime-O-methyl nucleosides
ccacagttaatgcacttagaa

SEQ ID NO: 1416 - RNA, 21 nt, synthetic construct
  source 1..21: mol_type = other RNA
  modified_base order(1..8,14..18,20..21): mod_base = OTHER; note = 2 prime-O-methyl nucleosides
cacagttaatgcacttagata

SEQ ID NO: 1417 - RNA, 21 nt, synthetic construct
  source 1..21: mol_type = other RNA
  modified_base order(1..8,14..18,20..21): mod_base = OTHER; note = 2 prime-O-methyl nucleosides
acagttaatgcacttagatca

SEQ ID NO: 1418 - RNA, 21 nt, synthetic construct
  source 1..21: mol_type = other RNA
  modified_base order(1..8,14..18,20..21): mod_base = OTHER; note = 2 prime-O-methyl nucleosides
cagttaatgcacttagatcca

SEQ ID NO: 1419 - RNA, 21 nt, synthetic construct
  source 1..21: mol_type = other RNA
  modified_base order(1..8,14..18,20..21): mod_base = OTHER; note = 2 prime-O-methyl nucleosides
agttaatgcacttagatccaa

SEQ ID NO: 1420 - RNA, 21 nt, synthetic construct
  source 1..21: mol_type = other RNA
  modified_base order(1..8,14..18,20..21): mod_base = OTHER; note = 2 prime-O-methyl nucleosides
tgcacttagatccagaaatca

SEQ ID NO: 1421 - RNA, 21 nt, synthetic construct
  source 1..21: mol_type = other RNA
  modified_base order(1..8,14..18,20..21): mod_base = OTHER; note = 2 prime-O-methyl nucleosides
gcacttagatccagaaatcta

SEQ ID NO: 1422 - RNA, 21 nt, synthetic construct
  source 1..21: mol_type = other RNA
  modified_base order(1..8,14..18,20..21): mod_base = OTHER; note = 2 prime-O-methyl nucleosides
agaaatctacccagaccctta

SEQ ID NO: 1423 - RNA, 21 nt, synthetic construct
  source 1..21: mol_type = other RNA
  modified_base order(1..8,14..18,20..21): mod_base = OTHER; note = 2 prime-O-methyl nucleosides
acttttaaatatgataggtaa

SEQ ID NO: 1424 - RNA, 21 nt, synthetic construct
  source 1..21: mol_type = other RNA
  modified_base order(1..8,14..18,20..21): mod_base = OTHER; note = 2 prime-O-methyl nucleosides
ttttaaatatgataggtatca

SEQ ID NO: 1425 - RNA, 21 nt, synthetic construct
  source 1..21: mol_type = other RNA
  modified_base order(1..8,14..18,20..21): mod_base = OTHER; note = 2 prime-O-methyl nucleosides
tttaaatatgataggtatcta

SEQ ID NO: 1426 - RNA, 21 nt, synthetic construct
  source 1..21: mol_type = other RNA
  modified_base order(1..8,14..18,20..21): mod_base = OTHER; note = 2 prime-O-methyl nucleosides
taaatatgataggtatcttga

SEQ ID NO: 1427 - RNA, 21 nt, synthetic construct
  source 1..21: mol_type = other RNA
  modified_base order(1..8,14..18,20..21): mod_base = OTHER; note = 2 prime-O-methyl nucleosides
aatatgataggtatcttgata

SEQ ID NO: 1428 - RNA, 21 nt, synthetic construct
  source 1..21: mol_type = other RNA
  modified_base order(1..8,14..18,20..21): mod_base = OTHER; note = 2 prime-O-methyl nucleosides
atatgataggtatcttgatga

SEQ ID NO: 1429 - RNA, 21 nt, synthetic construct
  source 1..21: mol_type = other RNA
  modified_base order(1..8,14..18,20..21): mod_base = OTHER; note = 2 prime-O-methyl nucleosides
tatgataggtatcttgatgaa

SEQ ID NO: 1430 - RNA, 21 nt, synthetic construct
  source 1..21: mol_type = other RNA
  modified_base order(1..8,14..18,20..21): mod_base = OTHER; note = 2 prime-O-methyl nucleosides
atgataggtatcttgatgaaa

SEQ ID NO: 1431 - RNA, 21 nt, synthetic construct
  source 1..21: mol_type = other RNA
  modified_base order(1..8,14..18,20..21): mod_base = OTHER; note = 2 prime-O-methyl nucleosides
ataggtatcttgatgaaaaca

SEQ ID NO: 1432 - RNA, 21 nt, synthetic construct
  source 1..21: mol_type = other RNA
  modified_base order(1..8,14..18,20..21): mod_base = OTHER; note = 2 prime-O-methyl nucleosides
taggtatcttgatgaaaacga

SEQ ID NO: 1433 - RNA, 21 nt, synthetic construct
  source 1..21: mol_type = other RNA
  modified_base order(1..8,14..18,20..21): mod_base = OTHER; note = 2 prime-O-methyl nucleosides
aggtatcttgatgaaaacgga

SEQ ID NO: 1434 - RNA, 21 nt, synthetic construct
  source 1..21: mol_type = other RNA
  modified_base order(1..8,14..18,20..21): mod_base = OTHER; note = 2 prime-O-methyl nucleosides
ggtatcttgatgaaaacggga

SEQ ID NO: 1435 - RNA, 21 nt, synthetic construct
  source 1..21: mol_type = other RNA
  modified_base order(1..8,14..18,20..21): mod_base = OTHER; note = 2 prime-O-methyl nucleosides
gtatcttgatgaaaacgggaa

SEQ ID NO: 1436 - RNA, 21 nt, synthetic construct
  source 1..21: mol_type = other RNA
  modified_base order(1..8,14..18,20..21): mod_base = OTHER; note = 2 prime-O-methyl nucleosides
tatcttgatgaaaacgggaaa

SEQ ID NO: 1437 - RNA, 21 nt, synthetic construct
  source 1..21: mol_type = other RNA
  modified_base order(1..8,14..18,20..21): mod_base = OTHER; note = 2 prime-O-methyl nucleosides
atcttgatgaaaacgggaaga

SEQ ID NO: 1438 - RNA, 21 nt, synthetic construct
  source 1..21: mol_type = other RNA
  modified_base order(1..8,14..18,20..21): mod_base = OTHER; note = 2 prime-O-methyl nucleosides
tcttgatgaaaacgggaagaa

SEQ ID NO: 1439 - RNA, 21 nt, synthetic construct
  source 1..21: mol_type = other RNA
  modified_base order(1..8,14..18,20..21): mod_base = OTHER; note = 2 prime-O-methyl nucleosides
tgatgaaaacgggaagacaaa

SEQ ID NO: 1440 - RNA, 21 nt, synthetic construct
  source 1..21: mol_type = other RNA
  modified_base order(1..8,14..18,20..21): mod_base = OTHER; note = 2 prime-O-methyl nucleosides
gatgaaaacgggaagacaaaa

SEQ ID NO: 1441 - RNA, 21 nt, synthetic construct
  source 1..21: mol_type = other RNA
  modified_base order(1..8,14..18,20..21): mod_base = OTHER; note = 2 prime-O-methyl nucleosides
aaaacgggaagacaaagacta

SEQ ID NO: 1442 - RNA, 21 nt, synthetic construct
  source 1..21: mol_type = other RNA
  modified_base order(1..8,14..18,20..21): mod_base = OTHER; note = 2 prime-O-methyl nucleosides
aacgggaagacaaagactaca

SEQ ID NO: 1443 - RNA, 21 nt, synthetic construct
  source 1..21: mol_type = other RNA
  modified_base order(1..8,14..18,20..21): mod_base = OTHER; note = 2 prime-O-methyl nucleosides
acgggaagacaaagactacca

SEQ ID NO: 1444 - RNA, 21 nt, synthetic construct
  source 1..21: mol_type = other RNA
  modified_base order(1..8,14..18,20..21): mod_base = OTHER; note = 2 prime-O-methyl nucleosides
agttaaagtattactacatga

SEQ ID NO: 1445 - RNA, 21 nt, synthetic construct
  source 1..21: mol_type = other RNA
  modified_base order(1..8,14..18,20..21): mod_base = OTHER; note = 2 prime-O-methyl nucleosides
gttaaagtattactacatgca

SEQ ID NO: 1446 - RNA, 21 nt, synthetic construct
  source 1..21: mol_type = other RNA
  modified_base order(1..8,14..18,20..21): mod_base = OTHER; note = 2 prime-O-methyl nucleosides
aagtattactacatgccctta

SEQ ID NO: 1447 - RNA, 21 nt, synthetic construct
  source 1..21: mol_type = other RNA
  modified_base order(1..8,14..18,20..21): mod_base = OTHER; note = 2 prime-O-methyl nucleosides
gtattactacatgccctttga

SEQ ID NO: 1448 - RNA, 21 nt, synthetic construct
  source 1..21: mol_type = other RNA
  modified_base order(1..8,14..18,20..21): mod_base = OTHER; note = 2 prime-O-methyl nucleosides
tattactacatgccctttgga

SEQ ID NO: 1449 - RNA, 21 nt, synthetic construct
  source 1..21: mol_type = other RNA
  modified_base order(1..8,14..18,20..21): mod_base = OTHER; note = 2 prime-O-methyl nucleosides
ttactacatgccctttggata

SEQ ID NO: 1450 - RNA, 21 nt, synthetic construct
  source 1..21: mol_type = other RNA
  modified_base order(1..8,14..18,20..21): mod_base = OTHER; note = 2 prime-O-methyl nucleosides
tactacatgccctttggatca

SEQ ID NO: 1451 - RNA, 21 nt, synthetic construct
  source 1..21: mol_type = other RNA
  modified_base order(1..8,14..18,20..21): mod_base = OTHER; note = 2 prime-O-methyl nucleosides
tcgggagctacaatatgtcca

SEQ ID NO: 1452 - RNA, 21 nt, synthetic construct
  source 1..21: mol_type = other RNA
  modified_base order(1..8,14..18,20..21): mod_base = OTHER; note = 2 prime-O-methyl nucleosides
gagctacaatatgtcctggaa

SEQ ID NO: 1453 - RNA, 21 nt, synthetic construct
  source 1..21: mol_type = other RNA
  modified_base order(1..8,14..18,20..21): mod_base = OTHER; note = 2 prime-O-methyl nucleosides
gctacaatatgtcctggaaga

SEQ ID NO: 1454 - RNA, 21 nt, synthetic construct
  source 1..21: mol_type = other RNA
  modified_base order(1..8,14..18,20..21): mod_base = OTHER; note = 2 prime-O-methyl nucleosides
ctacaatatgtcctggaagaa

SEQ ID NO: 1455 - RNA, 21 nt, synthetic construct
  source 1..21: mol_type = other RNA
  modified_base order(1..8,14..18,20..21): mod_base = OTHER; note = 2 prime-O-methyl nucleosides
tcgctatccacgaaatcaaga

SEQ ID NO: 1456 - RNA, 21 nt, synthetic construct
  source 1..21: mol_type = other RNA
  modified_base order(1..8,14..18,20..21): mod_base = OTHER; note = 2 prime-O-methyl nucleosides
gctatccacgaaatcaagcaa

SEQ ID NO: 1457 - RNA, 21 nt, synthetic construct
  source 1..21: mol_type = other RNA
  modified_base order(1..8,14..18,20..21): mod_base = OTHER; note = 2 prime-O-methyl nucleosides
ctatccacgaaatcaagcaaa

SEQ ID NO: 1458 - RNA, 21 nt, synthetic construct
  source 1..21: mol_type = other RNA
  modified_base order(1..8,14..18,20..21): mod_base = OTHER; note = 2 prime-O-methyl nucleosides
tatccacgaaatcaagcaata

SEQ ID NO: 1459 - RNA, 21 nt, synthetic construct
  source 1..21: mol_type = other RNA
  modified_base order(1..8,14..18,20..21): mod_base = OTHER; note = 2 prime-O-methyl nucleosides
gaaatcaagcaatttttgata

SEQ ID NO: 1460 - RNA, 21 nt, synthetic construct
  source 1..21: mol_type = other RNA
  modified_base order(1..8,14..18,20..21): mod_base = OTHER; note = 2 prime-O-methyl nucleosides
aaatcaagcaatttttgatta

SEQ ID NO: 1461 - RNA, 21 nt, synthetic construct
  source 1..21: mol_type = other RNA
  modified_base order(1..8,14..18,20..21): mod_base = OTHER; note = 2 prime-O-methyl nucleosides
agcaatttttgattctgatga

SEQ ID NO: 1462 - RNA, 21 nt, synthetic construct
  source 1..21: mol_type = other RNA
  modified_base order(1..8,14..18,20..21): mod_base = OTHER; note = 2 prime-O-methyl nucleosides
caatttttgattctgatgcta

SEQ ID NO: 1463 - RNA, 21 nt, synthetic construct
  source 1..21: mol_type = other RNA
  modified_base order(1..8,14..18,20..21): mod_base = OTHER; note = 2 prime-O-methyl nucleosides
accagtcccgggcaggcttga

SEQ ID NO: 1464 - RNA, 21 nt, synthetic construct
  source 1..21: mol_type = other RNA
  modified_base order(1..8,14..18,20..21): mod_base = OTHER; note = 2 prime-O-methyl nucleosides
ccagtcccgggcaggcttgga

SEQ ID NO: 1465 - RNA, 21 nt, synthetic construct
  source 1..21: mol_type = other RNA
  modified_base order(1..8,14..18,20..21): mod_base = OTHER; note = 2 prime-O-methyl nucleosides
gtcccgggcaggcttgggcaa

SEQ ID NO: 1466 - RNA, 21 nt, synthetic construct
  source 1..21: mol_type = other RNA
  modified_base order(1..8,14..18,20..21): mod_base = OTHER; note = 2 prime-O-methyl nucleosides
tcccgggcaggcttgggcata

SEQ ID NO: 1467 - RNA, 21 nt, synthetic construct
  source 1..21: mol_type = other RNA
  modified_base order(1..8,14..18,20..21): mod_base = OTHER; note = 2 prime-O-methyl nucleosides
ccgggcaggcttgggcattta

SEQ ID NO: 1468 - RNA, 21 nt, synthetic construct
  source 1..21: mol_type = other RNA
  modified_base order(1..8,14..18,20..21): mod_base = OTHER; note = 2 prime-O-methyl nucleosides
caggcttgggcattttgccga

SEQ ID NO: 1469 - RNA, 21 nt, synthetic construct
  source 1..21: mol_type = other RNA
  modified_base order(1..8,14..18,20..21): mod_base = OTHER; note = 2 prime-O-methyl nucleosides
atttaaatataaattcaagca

SEQ ID NO: 1470 - RNA, 21 nt, synthetic construct
  source 1..21: mol_type = other RNA
  modified_base order(1..8,14..18,20..21): mod_base = OTHER; note = 2 prime-O-methyl nucleosides
tttaaatataaattcaagcaa

SEQ ID NO: 1471 - RNA, 21 nt, synthetic construct
  source 1..21: mol_type = other RNA
  modified_base order(1..8,14..18,20..21): mod_base = OTHER; note = 2 prime-O-methyl nucleosides
ttaaatataaattcaagcata

SEQ ID NO: 1472 - RNA, 21 nt, synthetic construct
  source 1..21: mol_type = other RNA
  modified_base order(1..8,14..18,20..21): mod_base = OTHER; note = 2 prime-O-methyl nucleosides
taaatataaattcaagcatta

SEQ ID NO: 1473 - RNA, 21 nt, synthetic construct
  source 1..21: mol_type = other RNA
  modified_base order(1..8,14..18,20..21): mod_base = OTHER; note = 2 prime-O-methyl nucleosides
aaatataaattcaagcattta

SEQ ID NO: 1474 - RNA, 21 nt, synthetic construct
  source 1..21: mol_type = other RNA
  modified_base order(1..8,14..18,20..21): mod_base = OTHER; note = 2 prime-O-methyl nucleosides
atataaattcaagcatttgta

SEQ ID NO: 1475 - RNA, 21 nt, synthetic construct
  source 1..21: mol_type = other RNA
  modified_base order(1..8,14..18,20..21): mod_base = OTHER; note = 2 prime-O-methyl nucleosides
ggaataagaggacactagata

SEQ ID NO: 1476 - RNA, 21 nt, synthetic construct
  source 1..21: mol_type = other RNA
  modified_base order(1..8,14..18,20..21): mod_base = OTHER; note = 2 prime-O-methyl nucleosides
gaataagaggacactagatga

SEQ ID NO: 1477 - RNA, 21 nt, synthetic construct
  source 1..21: mol_type = other RNA
  modified_base order(1..8,14..18,20..21): mod_base = OTHER; note = 2 prime-O-methyl nucleosides
taagaggacactagatgataa

SEQ ID NO: 1478 - RNA, 21 nt, synthetic construct
  source 1..21: mol_type = other RNA
  modified_base order(1..8,14..18,20..21): mod_base = OTHER; note = 2 prime-O-methyl nucleosides
agaggacactagatgatatta

SEQ ID NO: 1479 - RNA, 21 nt, synthetic construct
  source 1..21: mol_type = other RNA
  modified_base order(1..8,14..18,20..21): mod_base = OTHER; note = 2 prime-O-methyl nucleosides
aggacactagatgatattaca

SEQ ID NO: 1480 - RNA, 21 nt, synthetic construct
  source 1..21: mol_type = other RNA
  modified_base order(1..8,14..18,20..21): mod_base = OTHER; note = 2 prime-O-methyl nucleosides
cactagatgatattacaggaa

SEQ ID NO: 1481 - RNA, 21 nt, synthetic construct
  source 1..21: mol_type = other RNA
  modified_base order(1..8,14..18,20..21): mod_base = OTHER; note = 2 prime-O-methyl nucleosides
actagatgatattacaggaca

SEQ ID NO: 1482 - RNA, 21 nt, synthetic construct
  source 1..21: mol_type = other RNA
  modified_base order(1..8,14..18,20..21): mod_base = OTHER; note = 2 prime-O-methyl nucleosides
agatgatattacaggactgca

SEQ ID NO: 1483 - RNA, 21 nt, synthetic construct
  source 1..21: mol_type = other RNA
  modified_base order(1..8,14..18,20..21): mod_base = OTHER; note = 2 prime-O-methyl nucleosides
gatgatattacaggactgcaa

SEQ ID NO: 1484 - RNA, 21 nt, synthetic construct
  source 1..21: mol_type = other RNA
  modified_base order(1..8,14..18,20..21): mod_base = OTHER; note = 2 prime-O-methyl nucleosides
atattacaggactgcagaaca

SEQ ID NO: 1485 - RNA, 21 nt, synthetic construct
  source 1..21: mol_type = other RNA
  modified_base order(1..8,14..18,20..21): mod_base = OTHER; note = 2 prime-O-methyl nucleosides
tcaccacacagtccctttgga

SEQ ID NO: 1486 - RNA, 21 nt, synthetic construct
  source 1..21: mol_type = other RNA
  modified_base order(1..8,14..18,20..21): mod_base = OTHER; note = 2 prime-O-methyl nucleosides
aaatgcatttagtggtggtaa

SEQ ID NO: 1487 - RNA, 21 nt, synthetic construct
  source 1..21: mol_type = other RNA
  modified_base order(1..8,14..18,20..21): mod_base = OTHER; note = 2 prime-O-methyl nucleosides
aatgcatttagtggtggtaga

SEQ ID NO: 1488 - RNA, 21 nt, synthetic construct
  source 1..21: mol_type = other RNA
  modified_base order(1..8,14..18,20..21): mod_base = OTHER; note = 2 prime-O-methyl nucleosides
atgcatttagtggtggtagaa

SEQ ID NO: 1489 - RNA, 21 nt, synthetic construct
  source 1..21: mol_type = other RNA
  modified_base order(1..8,14..18,20..21): mod_base = OTHER; note = 2 prime-O-methyl nucleosides
tgcatttagtggtggtagaaa

SEQ ID NO: 1490 - RNA, 21 nt, synthetic construct
  source 1..21: mol_type = other RNA
  modified_base order(1..8,14..18,20..21): mod_base = OTHER; note = 2 prime-O-methyl nucleosides
tagtggtggtagaaatgatta

SEQ ID NO: 1491 - RNA, 21 nt, synthetic construct
  source 1..21: mol_type = other RNA
  modified_base order(1..8,14..18,20..21): mod_base = OTHER; note = 2 prime-O-methyl nucleosides
gtggtggtagaaatgattcaa

SEQ ID NO: 1492 - RNA, 21 nt, synthetic construct
  source 1..21: mol_type = other RNA
  modified_base order(1..8,14..18,20..21): mod_base = OTHER; note = 2 prime-O-methyl nucleosides
ggtggtagaaatgattcacca

SEQ ID NO: 1493 - RNA, 21 nt, synthetic construct
  source 1..21: mol_type = other RNA
  modified_base order(1..8,14..18,20..21): mod_base = OTHER; note = 2 prime-O-methyl nucleosides
ggtagaaatgattcaccagga

SEQ ID NO: 1494 - RNA, 21 nt, synthetic construct
  source 1..21: mol_type = other RNA
  modified_base order(1..8,14..18,20..21): mod_base = OTHER; note = 2 prime-O-methyl nucleosides
atgattcaccaggtccaatga

SEQ ID NO: 1495 - RNA, 21 nt, synthetic construct
  source 1..21: mol_type = other RNA
  modified_base order(1..8,14..18,20..21): mod_base = OTHER; note = 2 prime-O-methyl nucleosides
attcaccaggtccaatgttga

SEQ ID NO: 1496 - RNA, 21 nt, synthetic construct
  source 1..21: mol_type = other RNA
  modified_base order(1..8,14..18,20..21): mod_base = OTHER; note = 2 prime-O-methyl nucleosides
caccaggtccaatgttgttca

SEQ ID NO: 1497 - RNA, 21 nt, synthetic construct
  source 1..21: mol_type = other RNA
  modified_base order(1..8,14..18,20..21): mod_base = OTHER; note = 2 prime-O-methyl nucleosides
accaggtccaatgttgttcaa

SEQ ID NO: 1498 - RNA, 21 nt, synthetic construct
  source 1..21: mol_type = other RNA
  modified_base order(1..8,14..18,20..21): mod_base = OTHER; note = 2 prime-O-methyl nucleosides
caggtccaatgttgttcacca

SEQ ID NO: 1499 - RNA, 21 nt, synthetic construct
  source 1..21: mol_type = other RNA
  modified_base order(1..8,14..18,20..21): mod_base = OTHER; note = 2 prime-O-methyl nucleosides
agtgcttgcttgtgaatctta

SEQ ID NO: 1500 - RNA, 21 nt, synthetic construct
  source 1..21: mol_type = other RNA
  modified_base order(1..8,14..18,20..21): mod_base = OTHER; note = 2 prime-O-methyl nucleosides
gtgcttgcttgtgaatcttaa

SEQ ID NO: 1501 - RNA, 21 nt, synthetic construct
  source 1..21: mol_type = other RNA
  modified_base order(1..8,14..18,20..21): mod_base = OTHER; note = 2 prime-O-methyl nucleosides
tctgctagtgaaaagaactaa

SEQ ID NO: 1502 - RNA, 21 nt, synthetic construct
  source 1..21: mol_type = other RNA
  modified_base order(1..8,14..18,20..21): mod_base = OTHER; note = 2 prime-O-methyl nucleosides
ctgctagtgaaaagaactaga

SEQ ID NO: 1503 - RNA, 21 nt, synthetic construct
  source 1..21: mol_type = other RNA
  modified_base order(1..8,14..18,20..21): mod_base = OTHER; note = 2 prime-O-methyl nucleosides
taagtccatgaatgttcataa

SEQ ID NO: 1504 - RNA, 21 nt, synthetic construct
  source 1..21: mol_type = other RNA
  modified_base order(1..8,14..18,20..21): mod_base = OTHER; note = 2 prime-O-methyl nucleosides
aagtccatgaatgttcatata

SEQ ID NO: 1505 - RNA, 21 nt, synthetic construct
  source 1..21: mol_type = other RNA
  modified_base order(1..8,14..18,20..21): mod_base = OTHER; note = 2 prime-O-methyl nucleosides
agtccatgaatgttcatataa

SEQ ID NO: 1506 - RNA, 21 nt, synthetic construct
  source 1..21: mol_type = other RNA
  modified_base order(1..8,14..18,20..21): mod_base = OTHER; note = 2 prime-O-methyl nucleosides
gtccatgaatgttcatataga

SEQ ID NO: 1507 - RNA, 21 nt, synthetic construct
  source 1..21: mol_type = other RNA
  modified_base order(1..8,14..18,20..21): mod_base = OTHER; note = 2 prime-O-methyl nucleosides
tccatgaatgttcatatagca

SEQ ID NO: 1508 - RNA, 21 nt, synthetic construct
  source 1..21: mol_type = other RNA
  modified_base order(1..8,14..18,20..21): mod_base = OTHER; note = 2 prime-O-methyl nucleosides
ccatgaatgttcatatagcca

SEQ ID NO: 1509 - RNA, 21 nt, synthetic construct
  source 1..21: mol_type = other RNA
  modified_base order(1..8,14..18,20..21): mod_base = OTHER; note = 2 prime-O-methyl nucleosides
catgaatgttcatatagccaa

SEQ ID NO: 1510 - RNA, 21 nt, synthetic construct
  source 1..21: mol_type = other RNA
  modified_base order(1..8,14..18,20..21): mod_base = OTHER; note = 2 prime-O-methyl nucleosides
tttttttcaaaatgaagataa

SEQ ID NO: 1511 - RNA, 21 nt, synthetic construct
  source 1..21: mol_type = other RNA
  modified_base order(1..8,14..18,20..21): mod_base = OTHER; note = 2 prime-O-methyl nucleosides
tgtattctaattggcagatta

SEQ ID NO: 1512 - RNA, 21 nt, synthetic construct
  source 1..21: mol_type = other RNA
  modified_base order(1..8,14..18,20..21): mod_base = OTHER; note = 2 prime-O-methyl nucleosides
gtattctaattggcagattga

SEQ ID NO: 1513 - RNA, 21 nt, synthetic construct
  source 1..21: mol_type = other RNA
  modified_base order(1..8,14..18,20..21): mod_base = OTHER; note = 2 prime-O-methyl nucleosides
ttttcctaaggaaactgctta

SEQ ID NO: 1514 - RNA, 21 nt, synthetic construct
  source 1..21: mol_type = other RNA
  modified_base order(1..8,14..18,20..21): mod_base = OTHER; note = 2 prime-O-methyl nucleosides
aaatgttcaaattcacgttca

SEQ ID NO: 1515 - RNA, 21 nt, synthetic construct
  source 1..21: mol_type = other RNA
  modified_base order(1..8,14..18,20..21): mod_base = OTHER; note = 2 prime-O-methyl nucleosides
aatgttcaaattcacgttcta

SEQ ID NO: 1516 - RNA, 21 nt, synthetic construct
  source 1..21: mol_type = other RNA
  modified_base order(1..8,14..18,20..21): mod_base = OTHER; note = 2 prime-O-methyl nucleosides
ttcaaattcacgttctagtga

SEQ ID NO: 1517 - RNA, 21 nt, synthetic construct
  source 1..21: mol_type = other RNA
  modified_base order(1..8,14..18,20..21): mod_base = OTHER; note = 2 prime-O-methyl nucleosides
tcaaattcacgttctagtgaa

SEQ ID NO: 1518 - RNA, 21 nt, synthetic construct
  source 1..21: mol_type = other RNA
  modified_base order(1..8,14..18,20..21): mod_base = OTHER; note = 2 prime-O-methyl nucleosides
caaattcacgttctagtgaaa

SEQ ID NO: 1519 - RNA, 21 nt, synthetic construct
  source 1..21: mol_type = other RNA
  modified_base order(1..8,14..18,20..21): mod_base = OTHER; note = 2 prime-O-methyl nucleosides
aaattcacgttctagtgaaaa

SEQ ID NO: 1520 - RNA, 21 nt, synthetic construct
  source 1..21: mol_type = other RNA
  modified_base order(1..8,14..18,20..21): mod_base = OTHER; note = 2 prime-O-methyl nucleosides
aattcacgttctagtgaaaca

SEQ ID NO: 1521 - RNA, 21 nt, synthetic construct
  source 1..21: mol_type = other RNA
  modified_base order(1..8,14..18,20..21): mod_base = OTHER; note = 2 prime-O-methyl nucleosides
attcacgttctagtgaaacta

SEQ ID NO: 1522 - RNA, 21 nt, synthetic construct
  source 1..21: mol_type = other RNA
  modified_base order(1..8,14..18,20..21): mod_base = OTHER; note = 2 prime-O-methyl nucleosides
tcacgttctagtgaaactgca

SEQ ID NO: 1523 - RNA, 21 nt, synthetic construct
  source 1..21: mol_type = other RNA
  modified_base order(1..8,14..18,20..21): mod_base = OTHER; note = 2 prime-O-methyl nucleosides
cacgttctagtgaaactgcaa

SEQ ID NO: 1524 - RNA, 21 nt, synthetic construct
  source 1..21: mol_type = other RNA
  modified_base order(1..8,14..18,20..21): mod_base = OTHER; note = 2 prime-O-methyl nucleosides
ttctagtgaaactgcattata

SEQ ID NO: 1525 - RNA, 21 nt, synthetic construct
  source 1..21: mol_type = other RNA
  modified_base order(1..8,14..18,20..21): mod_base = OTHER; note = 2 prime-O-methyl nucleosides
cgggtgtgatcatatatcata

SEQ ID NO: 1526 - RNA, 21 nt, synthetic construct
  source 1..21: mol_type = other RNA
  modified_base order(1..8,14..18,20..21): mod_base = OTHER; note = 2 prime-O-methyl nucleosides
gggtgtgatcatatatcataa

SEQ ID NO: 1527 - RNA, 21 nt, synthetic construct
  source 1..21: mol_type = other RNA
  modified_base order(1..8,14..18,20..21): mod_base = OTHER; note = 2 prime-O-methyl nucleosides
ggtgtgatcatatatcataaa

SEQ ID NO: 1528 - RNA, 21 nt, synthetic construct
  source 1..21: mol_type = other RNA
  modified_base order(1..8,14..18,20..21): mod_base = OTHER; note = 2 prime-O-methyl nucleosides
gtgtgatcatatatcataaaa

SEQ ID NO: 1529 - RNA, 21 nt, synthetic construct
  source 1..21: mol_type = other RNA
  modified_base order(1..8,14..18,20..21): mod_base = OTHER; note = 2 prime-O-methyl nucleosides
tgtgatcatatatcataaaga

SEQ ID NO: 1530 - RNA, 21 nt, synthetic construct
  source 1..21: mol_type = other RNA
  modified_base order(1..8,14..18,20..21): mod_base = OTHER; note = 2 prime-O-methyl nucleosides
gtgatcatatatcataaagga

SEQ ID NO: 1531 - RNA, 21 nt, synthetic construct
  source 1..21: mol_type = other RNA
  modified_base order(1..8,14..18,20..21): mod_base = OTHER; note = 2 prime-O-methyl nucleosides
tgatcatatatcataaaggaa

SEQ ID NO: 1532 - RNA, 21 nt, synthetic construct
  source 1..21: mol_type = other RNA
  modified_base order(1..8,14..18,20..21): mod_base = OTHER; note = 2 prime-O-methyl nucleosides
catatatcataaaggatatta

SEQ ID NO: 1533 - RNA, 21 nt, synthetic construct
  source 1..21: mol_type = other RNA
  modified_base order(1..8,14..18,20..21): mod_base = OTHER; note = 2 prime-O-methyl nucleosides
aaaggatatttcaaatgatta

SEQ ID NO: 1534 - RNA, 21 nt, synthetic construct
  source 1..21: mol_type = other RNA
  modified_base order(1..8,14..18,20..21): mod_base = OTHER; note = 2 prime-O-methyl nucleosides
aaggatatttcaaatgattaa

SEQ ID NO: 1535 - RNA, 21 nt, synthetic construct
  source 1..21: mol_type = other RNA
  modified_base order(1..8,14..18,20..21): mod_base = OTHER; note = 2 prime-O-methyl nucleosides
aggatatttcaaatgattata

SEQ ID NO: 1536 - RNA, 21 nt, synthetic construct
  source 1..21: mol_type = other RNA
  modified_base order(1..8,14..18,20..21): mod_base = OTHER; note = 2 prime-O-methyl nucleosides
tatttcaaatgattatgatta

SEQ ID NO: 1537 - RNA, 21 nt, synthetic construct
  source 1..21: mol_type = other RNA
  modified_base order(1..8,14..18,20..21): mod_base = OTHER; note = 2 prime-O-methyl nucleosides
atttcaaatgattatgattaa

SEQ ID NO: 1538 - RNA, 21 nt, synthetic construct
  source 1..21: mol_type = other RNA
  modified_base order(1..8,14..18,20..21): mod_base = OTHER; note = 2 prime-O-methyl nucleosides
tttcaaatgattatgattaga

SEQ ID NO: 1539 - RNA, 21 nt, synthetic construct
  source 1..21: mol_type = other RNA
  modified_base order(1..8,14..18,20..21): mod_base = OTHER; note = 2 prime-O-methyl nucleosides
ttcaaatgattatgattagta

SEQ ID NO: 1540 - RNA, 21 nt, synthetic construct
  source 1..21: mol_type = other RNA
  modified_base order(1..8,14..18,20..21): mod_base = OTHER; note = 2 prime-O-methyl nucleosides
caaatgattatgattagttaa

SEQ ID NO: 1541 - RNA, 21 nt, synthetic construct
  source 1..21: mol_type = other RNA
  modified_base order(1..8,14..18,20..21): mod_base = OTHER; note = 2 prime-O-methyl nucleosides
aaatgattatgattagttata

SEQ ID NO: 1542 - RNA, 21 nt, synthetic construct
  source 1..21: mol_type = other RNA
  modified_base order(1..8,14..18,20..21): mod_base = OTHER; note = 2 prime-O-methyl nucleosides
atgattatgattagttatgta

SEQ ID NO: 1543 - RNA, 21 nt, synthetic construct
  source 1..21: mol_type = other RNA
  modified_base order(1..8,14..18,20..21): mod_base = OTHER; note = 2 prime-O-methyl nucleosides
tgattatgattagttatgtca

SEQ ID NO: 1544 - RNA, 21 nt, synthetic construct
  source 1..21: mol_type = other RNA
  modified_base order(1..8,14..18,20..21): mod_base = OTHER; note = 2 prime-O-methyl nucleosides
gattatgattagttatgtcta

SEQ ID NO: 1545 - RNA, 21 nt, synthetic construct
  source 1..21: mol_type = other RNA
  modified_base order(1..8,14..18,20..21): mod_base = OTHER; note = 2 prime-O-methyl nucleosides
ttgatttcccaaaaacactaa

SEQ ID NO: 1546 - RNA, 21 nt, synthetic construct
  source 1..21: mol_type = other RNA
  modified_base order(1..8,14..18,20..21): mod_base = OTHER; note = 2 prime-O-methyl nucleosides
atttcccaaaaacactaaaga

SEQ ID NO: 1547 - RNA, 21 nt, synthetic construct
  source 1..21: mol_type = other RNA
  modified_base order(1..8,14..18,20..21): mod_base = OTHER; note = 2 prime-O-methyl nucleosides
tttcccaaaaacactaaagga

SEQ ID NO: 1548 - RNA, 21 nt, synthetic construct
  source 1..21: mol_type = other RNA
  modified_base order(1..8,14..18,20..21): mod_base = OTHER; note = 2 prime-O-methyl nucleosides
tcccaaaaacactaaaggtga

SEQ ID NO: 1549 - RNA, 21 nt, synthetic construct
  source 1..21: mol_type = other RNA
  modified_base order(1..8,14..18,20..21): mod_base = OTHER; note = 2 prime-O-methyl nucleosides
cccaaaaacactaaaggtgga

SEQ ID NO: 1550 - RNA, 21 nt, synthetic construct
  source 1..21: mol_type = other RNA
  modified_base order(1..8,14..18,20..21): mod_base = OTHER; note = 2 prime-O-methyl nucleosides
ccaaaaacactaaaggtggta

SEQ ID NO: 1551 - RNA, 21 nt, synthetic construct
  source 1..21: mol_type = other RNA
  modified_base order(1..8,14..18,20..21): mod_base = OTHER; note = 2 prime-O-methyl nucleosides
tcatgttttaacttattgtta

SEQ ID NO: 1552 - RNA, 21 nt, synthetic construct
  source 1..21: mol_type = other RNA
  modified_base order(1..8,14..18,20..21): mod_base = OTHER; note = 2 prime-O-methyl nucleosides
atgttttaacttattgttgca

SEQ ID NO: 1553 - RNA, 21 nt, synthetic construct
  source 1..21: mol_type = other RNA
  modified_base order(1..8,14..18,20..21): mod_base = OTHER; note = 2 prime-O-methyl nucleosides
tgttttaacttattgttgcta

SEQ ID NO: 1554 - RNA, 21 nt, synthetic construct
  source 1..21: mol_type = other RNA
  modified_base order(1..8,14..18,20..21): mod_base = OTHER; note = 2 prime-O-methyl nucleosides
aacttattgttgctgaaaaca

SEQ ID NO: 1555 - RNA, 21 nt, synthetic construct
  source 1..21: mol_type = other RNA
  modified_base order(1..8,14..18,20..21): mod_base = OTHER; note = 2 prime-O-methyl nucleosides
cttattgttgctgaaaactca

SEQ ID NO: 1556 - RNA, 21 nt, synthetic construct
  source 1..21: mol_type = other RNA
  modified_base order(1..8,14..18,20..21): mod_base = OTHER; note = 2 prime-O-methyl nucleosides
ttattgttgctgaaaactcta

SEQ ID NO: 1557 - RNA, 21 nt, synthetic construct
  source 1..21: mol_type = other RNA
  modified_base order(1..8,14..18,20..21): mod_base = OTHER; note = 2 prime-O-methyl nucleosides
tattgttgctgaaaactctaa

SEQ ID NO: 1558 - RNA, 21 nt, synthetic construct
  source 1..21: mol_type = other RNA
  modified_base order(1..8,14..18,20..21): mod_base = OTHER; note = 2 prime-O-methyl nucleosides
gttgctgaaaactctatgtca

SEQ ID NO: 1559 - RNA, 21 nt, synthetic construct
  source 1..21: mol_type = other RNA
  modified_base order(1..8,14..18,20..21): mod_base = OTHER; note = 2 prime-O-methyl nucleosides
aaaaatgtagcttttatgtga

SEQ ID NO: 1560 - RNA, 21 nt, synthetic construct
  source 1..21: mol_type = other RNA
  modified_base order(1..8,14..18,20..21): mod_base = OTHER; note = 2 prime-O-methyl nucleosides
ggaagctttggttatgaaaca

SEQ ID NO: 1561 - RNA, 21 nt, synthetic construct
  source 1..21: mol_type = other RNA
  modified_base order(1..8,14..18,20..21): mod_base = OTHER; note = 2 prime-O-methyl nucleosides
gaagctttggttatgaaacaa

SEQ ID NO: 1562 - RNA, 21 nt, synthetic construct
  source 1..21: mol_type = other RNA
  modified_base order(1..8,14..18,20..21): mod_base = OTHER; note = 2 prime-O-methyl nucleosides
atttaaatgctttttatcgca

SEQ ID NO: 1563 - RNA, 21 nt, synthetic construct
  source 1..21: mol_type = other RNA
  modified_base order(1..8,14..18,20..21): mod_base = OTHER; note = 2 prime-O-methyl nucleosides
tttaaatgctttttatcgcta

SEQ ID NO: 1564 - RNA, 21 nt, synthetic construct
  source 1..21: mol_type = other RNA
  modified_base order(1..8,14..18,20..21): mod_base = OTHER; note = 2 prime-O-methyl nucleosides
ttaaatgctttttatcgctaa

SEQ ID NO: 1565 - RNA, 21 nt, synthetic construct
  source 1..21: mol_type = other RNA
  modified_base order(1..8,14..18,20..21): mod_base = OTHER; note = 2 prime-O-methyl nucleosides
taaatgctttttatcgctaaa

SEQ ID NO: 1566 - RNA, 21 nt, synthetic construct
  source 1..21: mol_type = other RNA
  modified_base order(1..8,14..18,20..21): mod_base = OTHER; note = 2 prime-O-methyl nucleosides
aaatgctttttatcgctaaaa

SEQ ID NO: 1567 - RNA, 21 nt, synthetic construct
  source 1..21: mol_type = other RNA
  modified_base order(1..8,14..18,20..21): mod_base = OTHER; note = 2 prime-O-methyl nucleosides
aatgctttttatcgctaaata

SEQ ID NO: 1568 - RNA, 21 nt, synthetic construct
  source 1..21: mol_type = other RNA
  modified_base order(1..8,14..18,20..21): mod_base = OTHER; note = 2 prime-O-methyl nucleosides
ctttttatcgctaaatgacta

SEQ ID NO: 1569 - RNA, 21 nt, synthetic construct
  source 1..21: mol_type = other RNA
  modified_base order(1..8,14..18,20..21): mod_base = OTHER; note = 2 prime-O-methyl nucleosides
tttttatcgctaaatgactta

SEQ ID NO: 1570 - RNA, 21 nt, synthetic construct
  source 1..21: mol_type = other RNA
  modified_base order(1..8,14..18,20..21): mod_base = OTHER; note = 2 prime-O-methyl nucleosides
tttatcgctaaatgacttgca

SEQ ID NO: 1571 - RNA, 21 nt, synthetic construct
  source 1..21: mol_type = other RNA
  modified_base order(1..8,14..18,20..21): mod_base = OTHER; note = 2 prime-O-methyl nucleosides
ttatcgctaaatgacttgcaa

SEQ ID NO: 1572 - RNA, 21 nt, synthetic construct
  source 1..21: mol_type = other RNA
  modified_base order(1..8,14..18,20..21): mod_base = OTHER; note = 2 prime-O-methyl nucleosides
atcgctaaatgacttgcagaa

SEQ ID NO: 1573 - RNA, 21 nt, synthetic construct
  source 1..21: mol_type = other RNA
  modified_base order(1..8,14..18,20..21): mod_base = OTHER; note = 2 prime-O-methyl nucleosides
ctaaatgacttgcagatgaaa

SEQ ID NO: 1574 - RNA, 21 nt, synthetic construct
  source 1..21: mol_type = other RNA
  modified_base order(1..8,14..18,20..21): mod_base = OTHER; note = 2 prime-O-methyl nucleosides
tgtttaaatgctgtgtacaaa

SEQ ID NO: 1575 - RNA, 21 nt, synthetic construct
  source 1..21: mol_type = other RNA
  modified_base order(1..8,14..18,20..21): mod_base = OTHER; note = 2 prime-O-methyl nucleosides
ttaaatgctgtgtacaacaaa

SEQ ID NO: 1576 - RNA, 21 nt, synthetic construct
  source 1..21: mol_type = other RNA
  modified_base order(1..8,14..18,20..21): mod_base = OTHER; note = 2 prime-O-methyl nucleosides
taaatgctgtgtacaacaata

SEQ ID NO: 1577 - RNA, 21 nt, synthetic construct
  source 1..21: mol_type = other RNA
  modified_base order(1..8,14..18,20..21): mod_base = OTHER; note = 2 prime-O-methyl nucleosides
tgctgtgtacaacaatgctta

SEQ ID NO: 1578 - RNA, 21 nt, synthetic construct
  source 1..21: mol_type = other RNA
  modified_base order(1..8,14..18,20..21): mod_base = OTHER; note = 2 prime-O-methyl nucleosides
tgtgtacaacaatgctttgaa

SEQ ID NO: 1579 - RNA, 21 nt, synthetic construct
  source 1..21: mol_type = other RNA
  modified_base order(1..8,14..18,20..21): mod_base = OTHER; note = 2 prime-O-methyl nucleosides
gtgtacaacaatgctttgata

SEQ ID NO: 1580 - RNA, 21 nt, synthetic construct
  source 1..21: mol_type = other RNA
  modified_base order(1..8,14..18,20..21): mod_base = OTHER; note = 2 prime-O-methyl nucleosides
tgtacaacaatgctttgataa

SEQ ID NO: 1581 - RNA, 21 nt, synthetic construct
  source 1..21: mol_type = other RNA
  modified_base order(1..8,14..18,20..21): mod_base = OTHER; note = 2 prime-O-methyl nucleosides
gataattttgaaatgattcaa

SEQ ID NO: 1582 - RNA, 21 nt, synthetic construct
  source 1..21: mol_type = other RNA
  modified_base order(1..8,14..18,20..21): mod_base = OTHER; note = 2 prime-O-methyl nucleosides
ataattttgaaatgattcata

SEQ ID NO: 1583 - RNA, 21 nt, synthetic construct
  source 1..21: mol_type = other RNA
  modified_base order(1..8,14..18,20..21): mod_base = OTHER; note = 2 prime-O-methyl nucleosides
taattttgaaatgattcatca

SEQ ID NO: 1584 - RNA, 21 nt, synthetic construct
  source 1..21: mol_type = other RNA
  modified_base order(1..8,14..18,20..21): mod_base = OTHER; note = 2 prime-O-methyl nucleosides
ttttgaaatgattcatcttta

SEQ ID NO: 1585 - RNA, 21 nt, synthetic construct
  source 1..21: mol_type = other RNA
  modified_base order(1..8,14..18,20..21): mod_base = OTHER; note = 2 prime-O-methyl nucleosides
tttgaaatgattcatctttca

SEQ ID NO: 1586 - RNA, 21 nt, synthetic construct
  source 1..21: mol_type = other RNA
  modified_base order(1..8,14..18,20..21): mod_base = OTHER; note = 2 prime-O-methyl nucleosides
cagaaataaaagtatgaatca

SEQ ID NO: 1587 - RNA, 23 nt, synthetic construct
  source 1..23: mol_type = other RNA
  modified_base order(1,4,11,12,16,18,21..23): mod_base = OTHER; note = 2 prime-O-methyl nucleosides
tccaaaatctctgaggaagaatt

SEQ ID NO: 1588 - RNA, 23 nt, synthetic construct
  source 1..23: mol_type = other RNA
  modified_base order(1,4,11,12,16,18,21..23): mod_base = OTHER; note = 2 prime-O-methyl nucleosides
ttctaggccaaaatctctgagtt

SEQ ID NO: 1589 - RNA, 23 nt, synthetic construct
  source 1..23: mol_type = other RNA
  modified_base order(1,4,11,12,16,18,21..23): mod_base = OTHER; note = 2 prime-O-methyl nucleosides
tatctaggccaaaatctctgatt

SEQ ID NO: 1590 - RNA, 23 nt, synthetic construct
  source 1..23: mol_type = other RNA
  modified_base order(1,4,11,12,16,18,21..23): mod_base = OTHER; note = 2 prime-O-methyl nucleosides
taatctaggccaaaatctctgtt

SEQ ID NO: 1591 - RNA, 23 nt, synthetic construct
  source 1..23: mol_type = other RNA
  modified_base order(1,4,11,12,16,18,21..23): mod_base = OTHER; note = 2 prime-O-methyl nucleosides
taaatctaggccaaaatctcttt

SEQ ID NO: 1592 - RNA, 23 nt, synthetic construct
  source 1..23: mol_type = other RNA
  modified_base order(1,4,11,12,16,18,21..23): mod_base = OTHER; note = 2 prime-O-methyl nucleosides
tgcaaatctaggccaaaatcttt

SEQ ID NO: 1593 - RNA, 23 nt, synthetic construct
  source 1..23: mol_type = other RNA
  modified_base order(1,4,11,12,16,18,21..23): mod_base = OTHER; note = 2 prime-O-methyl nucleosides
tccatagacaacagcatgctgtt

SEQ ID NO: 1594 - RNA, 23 nt, synthetic construct
  source 1..23: mol_type = other RNA
  modified_base order(1,4,11,12,16,18,21..23): mod_base = OTHER; note = 2 prime-O-methyl nucleosides
tataagccatagacaacagcatt

SEQ ID NO: 1595 - RNA, 23 nt, synthetic construct
  source 1..23: mol_type = other RNA
  modified_base order(1,4,11,12,16,18,21..23): mod_base = OTHER; note = 2 prime-O-methyl nucleosides
taataagccatagacaacagctt

SEQ ID NO: 1596 - RNA, 23 nt, synthetic construct
  source 1..23: mol_type = other RNA
  modified_base order(1,4,11,12,16,18,21..23): mod_base = OTHER; note = 2 prime-O-methyl nucleosides
tgaataagccatagacaacagtt

SEQ ID NO: 1597 - RNA, 23 nt, synthetic construct
  source 1..23: mol_type = other RNA
  modified_base order(1,4,11,12,16,18,21..23): mod_base = OTHER; note = 2 prime-O-methyl nucleosides
tagaataagccatagacaacatt

SEQ ID NO: 1598 - RNA, 23 nt, synthetic construct
  source 1..23: mol_type = other RNA
  modified_base order(1,4,11,12,16,18,21..23): mod_base = OTHER; note = 2 prime-O-methyl nucleosides
tcaagaataagccatagacaatt

SEQ ID NO: 1599 - RNA, 23 nt, synthetic construct
  source 1..23: mol_type = other RNA
  modified_base order(1,4,11,12,16,18,21..23): mod_base = OTHER; note = 2 prime-O-methyl nucleosides
tccaagaataagccatagacatt

SEQ ID NO: 1600 - RNA, 23 nt, synthetic construct
  source 1..23: mol_type = other RNA
  modified_base order(1,4,11,12,16,18,21..23): mod_base = OTHER; note = 2 prime-O-methyl nucleosides
ttccaagaataagccatagactt

SEQ ID NO: 1601 - RNA, 23 nt, synthetic construct
  source 1..23: mol_type = other RNA
  modified_base order(1,4,11,12,16,18,21..23): mod_base = OTHER; note = 2 prime-O-methyl nucleosides
tttccaagaataagccatagatt

SEQ ID NO: 1602 - RNA, 23 nt, synthetic construct
  source 1..23: mol_type = other RNA
  modified_base order(1,4,11,12,16,18,21..23): mod_base = OTHER; note = 2 prime-O-methyl nucleosides
tcacccgtttgccttctcctatt

SEQ ID NO: 1603 - RNA, 23 nt, synthetic construct
  source 1..23: mol_type = other RNA
  modified_base order(1,4,11,12,16,18,21..23): mod_base = OTHER; note = 2 prime-O-methyl nucleosides
tttcacccgtttgccttctcctt

SEQ ID NO: 1604 - RNA, 23 nt, synthetic construct
  source 1..23: mol_type = other RNA
  modified_base order(1,4,11,12,16,18,21..23): mod_base = OTHER; note = 2 prime-O-methyl nucleosides
tgttcacccgtttgccttctctt

SEQ ID NO: 1605 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tggttcacccgtttgccttcttt

SEQ ID NO: 1606 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcacagcccaggtatggaatttt

SEQ ID NO: 1607 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgcacagcccaggtatggaattt

SEQ ID NO: 1608 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tagcacagcccaggtatggaatt

SEQ ID NO: 1609 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tattggcaccaaattgcagagtt

SEQ ID NO: 1610 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tggattggcaccaaattgcagtt

SEQ ID NO: 1611 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tctcaagaggattggcaccaatt

SEQ ID NO: 1612 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tggaactcaagaggattggcatt

SEQ ID NO: 1613 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tttgctctgaggaactcaagatt

SEQ ID NO: 1614 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatttgctctgaggaactcaatt

SEQ ID NO: 1615 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttttgatttgctctgaggaactt

SEQ ID NO: 1616 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tctttgatttgctctgaggaatt

SEQ ID NO: 1617 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgtttcctttgatttgctcttt

SEQ ID NO: 1618 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcatgtttcctttgatttgcttt

SEQ ID NO: 1619 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgaccatgtttcctttgatttt

SEQ ID NO: 1620 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatgaccatgtttcctttgattt

SEQ ID NO: 1621 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcatgaccatgtttcctttgatt

SEQ ID NO: 1622 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tacatgaccatgtttcctttgtt

SEQ ID NO: 1623 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taacatgaccatgtttccttttt

SEQ ID NO: 1624 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgtaaaaacatgaccatgttttt

SEQ ID NO: 1625 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taggtaaaaacatgaccatgttt

SEQ ID NO: 1626 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcaggtaaaaacatgaccatgtt

SEQ ID NO: 1627 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tttagtttgcaggtaaaaacatt

SEQ ID NO: 1628 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcattagtttgcaggtaaaaatt

SEQ ID NO: 1629 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcccattagtttgcaggtaaatt

SEQ ID NO: 1630 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttcccattagtttgcaggtaatt

SEQ ID NO: 1631 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tttcccattagtttgcaggtatt

SEQ ID NO: 1632 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatttgtgatgaaatggacattt

SEQ ID NO: 1633 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgatttgtgatgaaatggacatt

SEQ ID NO: 1634 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgggatttgtgatgaaatggatt

SEQ ID NO: 1635 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgacaagggatttgtgatgatt

SEQ ID NO: 1636 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttatgacaagggatttgtgattt

SEQ ID NO: 1637 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgtatgacaagggatttgtgatt

SEQ ID NO: 1638 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tggtatgacaagggatttgtgtt

SEQ ID NO: 1639 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttggtatgacaagggatttgttt

SEQ ID NO: 1640 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcttatggtatgacaagggattt

SEQ ID NO: 1641 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tccttatggtatgacaagggatt

SEQ ID NO: 1642 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taccttatggtatgacaagggtt

SEQ ID NO: 1643 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcaccttatggtatgacaaggtt

SEQ ID NO: 1644 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tacaccttatggtatgacaagtt

SEQ ID NO: 1645 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcaacaccttatggtatgacatt

SEQ ID NO: 1646 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tggcacaacaccttatggtattt

SEQ ID NO: 1647 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tagtagcaaagtgaaattttttt

SEQ ID NO: 1648 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tagaagtagcaaagtgaaatttt

SEQ ID NO: 1649 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgccttcgcagaagtagcaatt

SEQ ID NO: 1650 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taaatgccttcgcagaagtagtt

SEQ ID NO: 1651 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tccaaatgccttcgcagaagttt

SEQ ID NO: 1652 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taatgcttctgtgcccaaatgtt

SEQ ID NO: 1653 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttcaatgcttctgtgcccaaatt

SEQ ID NO: 1654 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tggtcaatgcttctgtgcccatt

SEQ ID NO: 1655 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcgtgagggaattcaaggcattt

SEQ ID NO: 1656 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tccgtgagggaattcaaggcatt

SEQ ID NO: 1657 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttccgtgagggaattcaaggctt

SEQ ID NO: 1658 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tttccgtgagggaattcaaggtt

SEQ ID NO: 1659 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttttccgtgagggaattcaagtt

SEQ ID NO: 1660 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatgctttccgtgagggaatttt

SEQ ID NO: 1661 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttcatgctttccgtgagggaatt

SEQ ID NO: 1662 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcatcatgctttccgtgagggtt

SEQ ID NO: 1663 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttccatcatgctttccgtgagtt

SEQ ID NO: 1664 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tacgttggaggttttccatcatt

SEQ ID NO: 1665 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatacgttggaggttttccattt

SEQ ID NO: 1666 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgatacgttggaggttttcctt

SEQ ID NO: 1667 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatgatacgttggaggttttctt

SEQ ID NO: 1668 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcatgatacgttggaggtttttt

SEQ ID NO: 1669 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tctcatgatacgttggaggtttt

SEQ ID NO: 1670 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttctcatgatacgttggaggttt

SEQ ID NO: 1671 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgtctcatgatacgttggaggtt

SEQ ID NO: 1672 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tggtctcatgatacgttggagtt

SEQ ID NO: 1673 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taggtctcatgatacgttggatt

SEQ ID NO: 1674 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgaggtctcatgatacgttggtt

SEQ ID NO: 1675 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgcggtctttgagttagaggatt

SEQ ID NO: 1676 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgtcacccaggcagcggtcttt

SEQ ID NO: 1677 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tacatcccttctgtcacccagtt

SEQ ID NO: 1678 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttacatcccttctgtcacccatt

SEQ ID NO: 1679 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatacatcccttctgtcaccctt

SEQ ID NO: 1680 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcatcactcggtagcagaaagtt

SEQ ID NO: 1681 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taacatcactcggtagcagaatt

SEQ ID NO: 1682 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taaacatcactcggtagcagatt

SEQ ID NO: 1683 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcaaacatcactcggtagcagtt

SEQ ID NO: 1684 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgcttcaaacatcactcggtatt

SEQ ID NO: 1685 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tagcttcaaacatcactcggttt

SEQ ID NO: 1686 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcagcttcaaacatcactcggtt

SEQ ID NO: 1687 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taaatacccagcttcaaacattt

SEQ ID NO: 1688 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgttaaatacccagcttcaaatt

SEQ ID NO: 1689 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tagttaaatacccagcttcaatt

SEQ ID NO: 1690 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttagttaaatacccagcttcatt

SEQ ID NO: 1691 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatagttaaatacccagcttctt

SEQ ID NO: 1692 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgatagttaaatacccagctttt

SEQ ID NO: 1693 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tagatagttaaatacccagcttt

SEQ ID NO: 1694 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taaagatagttaaatacccagtt

SEQ ID NO: 1695 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcaaagatagttaaatacccatt

SEQ ID NO: 1696 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatatgtgctttctgtgtgtctt

SEQ ID NO: 1697 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tattgtttagaatatgtgctttt

SEQ ID NO: 1698 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tagattgtttagaatatgtgctt

SEQ ID NO: 1699 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taagattgtttagaatatgtgtt

SEQ ID NO: 1700 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcaagattgtttagaatatgttt

SEQ ID NO: 1701 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgtcaagattgtttagaatattt

SEQ ID NO: 1702 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgtcaagattgtttagaatatt

SEQ ID NO: 1703 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tttgtcaagattgtttagaattt

SEQ ID NO: 1704 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tagttgtcaagattgtttagatt

SEQ ID NO: 1705 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgcttgaagttgtcaagattgtt

SEQ ID NO: 1706 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tctgctaccagggctggaaagtt

SEQ ID NO: 1707 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgctctctgccagtttctccctt

SEQ ID NO: 1708 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcgtgcctcaagctctctgcctt

SEQ ID NO: 1709 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taggttctcgtgcctcaagcttt

SEQ ID NO: 1710 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcattgagaaacatgcgcaggtt

SEQ ID NO: 1711 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgtcattgagaaacatgcgctt

SEQ ID NO: 1712 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tagtgtcattgagaaacatgctt

SEQ ID NO: 1713 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tacaaagtgtcattgagaaactt

SEQ ID NO: 1714 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgacaaagtgtcattgagaaatt

SEQ ID NO: 1715 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tggacaaagtgtcattgagaatt

SEQ ID NO: 1716 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatcaaaggtggacaaagtgttt

SEQ ID NO: 1717 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcatcaaaggtggacaaagtgtt

SEQ ID NO: 1718 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcccagaggaccacgaggtgttt

SEQ ID NO: 1719 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgcccagaggaccacgaggttt

SEQ ID NO: 1720 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatgcccagaggaccacgaggtt

SEQ ID NO: 1721 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgatgcccagaggaccacgagtt

SEQ ID NO: 1722 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcgatgcccagaggaccacgatt

SEQ ID NO: 1723 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgcttgcgatgcccagaggatt

SEQ ID NO: 1724 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgtttgcttgcgatgcccagatt

SEQ ID NO: 1725 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgtttgcttgcgatgcccagtt

SEQ ID NO: 1726 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgtgtttgcttgcgatgcccatt

SEQ ID NO: 1727 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatggtgtttgcttgcgatgctt

SEQ ID NO: 1728 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taatggtgtttgcttgcgatgtt

SEQ ID NO: 1729 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatttgaaataaactccagaatt

SEQ ID NO: 1730 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taatcatttgaaataaactcctt

SEQ ID NO: 1731 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttaatcatttgaaataaactctt

SEQ ID NO: 1732 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tctaatcatttgaaataaacttt

SEQ ID NO: 1733 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcctaatcatttgaaataaactt

SEQ ID NO: 1734 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgctgctttcattgcttctggtt

SEQ ID NO: 1735 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttagctgctttcattgcttcttt

SEQ ID NO: 1736 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgtagctgctttcattgcttctt

SEQ ID NO: 1737 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcttcagtagctgctttcatttt

SEQ ID NO: 1738 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttcttcagtagctgctttcattt

SEQ ID NO: 1739 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tacttcttcagtagctgcttttt

SEQ ID NO: 1740 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcacttcttcagtagctgctttt

SEQ ID NO: 1741 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttcacttcttcagtagctgcttt

SEQ ID NO: 1742 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tttcacttcttcagtagctgctt

SEQ ID NO: 1743 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttttcacttcttcagtagctgtt

SEQ ID NO: 1744 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttaatgttcttttcacttctttt

SEQ ID NO: 1745 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tctaatgttcttttcacttcttt

SEQ ID NO: 1746 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttctaatgttcttttcacttctt

SEQ ID NO: 1747 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tattctctaatgttcttttcatt

SEQ ID NO: 1748 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcattctctaatgttcttttctt

SEQ ID NO: 1749 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgcattctctaatgttctttttt

SEQ ID NO: 1750 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgaccagcattctctaatgtttt

SEQ ID NO: 1751 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgaccagcattctctaatgttt

SEQ ID NO: 1752 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tttgaccagcattctctaatgtt

SEQ ID NO: 1753 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttttgaccagcattctctaattt

SEQ ID NO: 1754 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgactttttgaccagcattcttt

SEQ ID NO: 1755 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgactttttgaccagcattctt

SEQ ID NO: 1756 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgctgactttttgaccagcattt

SEQ ID NO: 1757 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcttccaagctgactttttgatt

SEQ ID NO: 1758 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgccttccaagctgactttttt

SEQ ID NO: 1759 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgattgccttccaagctgacttt

SEQ ID NO: 1760 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatactggcaggtcattcagttt

SEQ ID NO: 1761 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tctaatactggcaggtcattctt

SEQ ID NO: 1762 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgttgagggaggcactggaaatt

SEQ ID NO: 1763 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttccttagctgtccggatgtttt

SEQ ID NO: 1764 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tctccttagctgtccggatgttt

SEQ ID NO: 1765 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatcctccttagctgtccggatt

SEQ ID NO: 1766 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgaaatcctccttagctgtcctt

SEQ ID NO: 1767 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgtgaaatcctccttagctgttt

SEQ ID NO: 1768 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taagtgaaatcctccttagcttt

SEQ ID NO: 1769 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgcaaagtgaaatcctccttatt

SEQ ID NO: 1770 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tggtgcaaagtgaaatcctcctt

SEQ ID NO: 1771 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taggtgcaaagtgaaatcctctt

SEQ ID NO: 1772 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcctcaaggtgcaaagtgaaatt

SEQ ID NO: 1773 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcgtcctcaaggtgcaaagtgtt

SEQ ID NO: 1774 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tccgtcctcaaggtgcaaagttt

SEQ ID NO: 1775 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgttgtaggaaccgtcctcatt

SEQ ID NO: 1776 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgatgttgtaggaaccgtccttt

SEQ ID NO: 1777 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttcggatgttgtaggaaccgttt

SEQ ID NO: 1778 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttttcggatgttgtaggaacctt

SEQ ID NO: 1779 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatcttttcggatgttgtaggtt

SEQ ID NO: 1780 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcatcttttcggatgttgtagtt

SEQ ID NO: 1781 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgtcatcttttcggatgttgttt

SEQ ID NO: 1782 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgtcatcttttcggatgttgtt

SEQ ID NO: 1783 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatgtcatcttttcggatgtttt

SEQ ID NO: 1784 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgatgtcatcttttcggatgtt

SEQ ID NO: 1785 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttatgatgtcatcttttcggatt

SEQ ID NO: 1786 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tagctatgatgtcatcttttctt

SEQ ID NO: 1787 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tagagctatgatgtcatcttttt

SEQ ID NO: 1788 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taagagctatgatgtcatctttt

SEQ ID NO: 1789 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttaaagagctatgatgtcatctt

SEQ ID NO: 1790 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taactgtgggtaaagagctattt

SEQ ID NO: 1791 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttaactgtgggtaaagagctatt

SEQ ID NO: 1792 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tttaactgtgggtaaagagcttt

SEQ ID NO: 1793 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tattaactgtgggtaaagagctt

SEQ ID NO: 1794 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcattaactgtgggtaaagagtt

SEQ ID NO: 1795 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgcattaactgtgggtaaagatt

SEQ ID NO: 1796 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgtgcattaactgtgggtaaatt

SEQ ID NO: 1797 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttaagtgcattaactgtgggttt

SEQ ID NO: 1798 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tctaagtgcattaactgtgggtt

SEQ ID NO: 1799 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttctaagtgcattaactgtggtt

SEQ ID NO: 1800 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatctaagtgcattaactgtgtt

SEQ ID NO: 1801 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgatctaagtgcattaactgttt

SEQ ID NO: 1802 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tggatctaagtgcattaactgtt

SEQ ID NO: 1803 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttggatctaagtgcattaacttt

SEQ ID NO: 1804 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgatttctggatctaagtgcatt

SEQ ID NO: 1805 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tagatttctggatctaagtgctt

SEQ ID NO: 1806 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taagggtctgggtagatttcttt

SEQ ID NO: 1807 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttacctatcatatttaaaagttt

SEQ ID NO: 1808 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgatacctatcatatttaaaatt

SEQ ID NO: 1809 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tagatacctatcatatttaaatt

SEQ ID NO: 1810 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcaagatacctatcatatttatt

SEQ ID NO: 1811 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatcaagatacctatcatatttt

SEQ ID NO: 1812 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcatcaagatacctatcatattt

SEQ ID NO: 1813 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttcatcaagatacctatcatatt

SEQ ID NO: 1814 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tttcatcaagatacctatcattt

SEQ ID NO: 1815 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgttttcatcaagatacctattt

SEQ ID NO: 1816 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcgttttcatcaagatacctatt

SEQ ID NO: 1817 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tccgttttcatcaagataccttt

SEQ ID NO: 1818 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcccgttttcatcaagatacctt

SEQ ID NO: 1819 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttcccgttttcatcaagatactt

SEQ ID NO: 1820 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tttcccgttttcatcaagatatt

SEQ ID NO: 1821 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcttcccgttttcatcaagattt

SEQ ID NO: 1822 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttcttcccgttttcatcaagatt

SEQ ID NO: 1823 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tttgtcttcccgttttcatcatt

SEQ ID NO: 1824 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttttgtcttcccgttttcatctt

SEQ ID NO: 1825 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tagtctttgtcttcccgtttttt

SEQ ID NO: 1826 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgtagtctttgtcttcccgtttt

SEQ ID NO: 1827 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tggtagtctttgtcttcccgttt

SEQ ID NO: 1828 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcatgtagtaatactttaacttt

SEQ ID NO: 1829 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgcatgtagtaatactttaactt

SEQ ID NO: 1830 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taagggcatgtagtaatactttt

SEQ ID NO: 1831 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcaaagggcatgtagtaatactt

SEQ ID NO: 1832 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tccaaagggcatgtagtaatatt

SEQ ID NO: 1833 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatccaaagggcatgtagtaatt

SEQ ID NO: 1834 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgatccaaagggcatgtagtatt

SEQ ID NO: 1835 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tggacatattgtagctcccgatt

SEQ ID NO: 1836 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttccaggacatattgtagctctt

SEQ ID NO: 1837 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcttccaggacatattgtagctt

SEQ ID NO: 1838 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttcttccaggacatattgtagtt

SEQ ID NO: 1839 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcttgatttcgtggatagcgatt

SEQ ID NO: 1840 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgcttgatttcgtggatagctt

SEQ ID NO: 1841 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tttgcttgatttcgtggatagtt

SEQ ID NO: 1842 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tattgcttgatttcgtggatatt

SEQ ID NO: 1843 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatcaaaaattgcttgatttctt

SEQ ID NO: 1844 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taatcaaaaattgcttgattttt

SEQ ID NO: 1845 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcatcagaatcaaaaattgcttt

SEQ ID NO: 1846 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tagcatcagaatcaaaaattgtt

SEQ ID NO: 1847 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcaagcctgcccgggactggttt

SEQ ID NO: 1848 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tccaagcctgcccgggactggtt

SEQ ID NO: 1849 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgcccaagcctgcccgggactt

SEQ ID NO: 1850 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatgcccaagcctgcccgggatt

SEQ ID NO: 1851 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taaatgcccaagcctgcccggtt

SEQ ID NO: 1852 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcggcaaaatgcccaagcctgtt

SEQ ID NO: 1853 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgcttgaatttatatttaaattt

SEQ ID NO: 1854 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgcttgaatttatatttaaatt

SEQ ID NO: 1855 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatgcttgaatttatatttaatt

SEQ ID NO: 1856 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taatgcttgaatttatatttatt

SEQ ID NO: 1857 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taaatgcttgaatttatattttt

SEQ ID NO: 1858 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tacaaatgcttgaatttatattt

SEQ ID NO: 1859 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatctagtgtcctcttattcctt

SEQ ID NO: 1860 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcatctagtgtcctcttattctt

SEQ ID NO: 1861 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttatcatctagtgtcctcttatt

SEQ ID NO: 1862 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taatatcatctagtgtcctcttt

SEQ ID NO: 1863 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgtaatatcatctagtgtccttt

SEQ ID NO: 1864 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttcctgtaatatcatctagtgtt

SEQ ID NO: 1865 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgtcctgtaatatcatctagttt

SEQ ID NO: 1866 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgcagtcctgtaatatcatcttt

SEQ ID NO: 1867 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgcagtcctgtaatatcatctt

SEQ ID NO: 1868 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgttctgcagtcctgtaatattt

SEQ ID NO: 1869 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tccaaagggactgtgtggtgatt

SEQ ID NO: 1870 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttaccaccactaaatgcattttt

SEQ ID NO: 1871 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tctaccaccactaaatgcatttt

SEQ ID NO: 1872 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttctaccaccactaaatgcattt

SEQ ID NO: 1873 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tttctaccaccactaaatgcatt

SEQ ID NO: 1874 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taatcatttctaccaccactatt

SEQ ID NO: 1875 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgaatcatttctaccaccactt

SEQ ID NO: 1876 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tggtgaatcatttctaccacctt

SEQ ID NO: 1877 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcctggtgaatcatttctacctt

SEQ ID NO: 1878 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcattggacctggtgaatcattt

SEQ ID NO: 1879 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcaacattggacctggtgaattt

SEQ ID NO: 1880 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgaacaacattggacctggtgtt

SEQ ID NO: 1881 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgaacaacattggacctggttt

SEQ ID NO: 1882 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tggtgaacaacattggacctgtt

SEQ ID NO: 1883 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taagattcacaagcaagcacttt

SEQ ID NO: 1884 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttaagattcacaagcaagcactt

SEQ ID NO: 1885 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttagttcttttcactagcagatt

SEQ ID NO: 1886 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tctagttcttttcactagcagtt

SEQ ID NO: 1887 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttatgaacattcatggacttatt

SEQ ID NO: 1888 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatatgaacattcatggactttt

SEQ ID NO: 1889 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttatatgaacattcatggacttt

SEQ ID NO: 1890 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tctatatgaacattcatggactt

SEQ ID NO: 1891 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgctatatgaacattcatggatt

SEQ ID NO: 1892 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tggctatatgaacattcatggtt

SEQ ID NO: 1893 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttggctatatgaacattcatgtt

SEQ ID NO: 1894 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttatcttcattttgaaaaaaatt

SEQ ID NO: 1895 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taatctgccaattagaatacatt

SEQ ID NO: 1896 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcaatctgccaattagaatactt

SEQ ID NO: 1897 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taagcagtttccttaggaaaatt

SEQ ID NO: 1898 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgaacgtgaatttgaacattttt

SEQ ID NO: 1899 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tagaacgtgaatttgaacatttt

SEQ ID NO: 1900 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcactagaacgtgaatttgaatt

SEQ ID NO: 1901 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttcactagaacgtgaatttgatt

SEQ ID NO: 1902 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tttcactagaacgtgaatttgtt

SEQ ID NO: 1903 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttttcactagaacgtgaattttt

SEQ ID NO: 1904 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgtttcactagaacgtgaatttt

SEQ ID NO: 1905 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tagtttcactagaacgtgaattt

SEQ ID NO: 1906 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgcagtttcactagaacgtgatt

SEQ ID NO: 1907 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgcagtttcactagaacgtgtt

SEQ ID NO: 1908 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tataatgcagtttcactagaatt

SEQ ID NO: 1909 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatgatatatgatcacacccgtt

SEQ ID NO: 1910 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttatgatatatgatcacaccctt

SEQ ID NO: 1911 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tttatgatatatgatcacacctt

SEQ ID NO: 1912 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttttatgatatatgatcacactt

SEQ ID NO: 1913 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tctttatgatatatgatcacatt

SEQ ID NO: 1914 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcctttatgatatatgatcactt

SEQ ID NO: 1915 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttcctttatgatatatgatcatt

SEQ ID NO: 1916 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taatatcctttatgatatatgtt

SEQ ID NO: 1917 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taatcatttgaaatatccttttt

SEQ ID NO: 1918 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttaatcatttgaaatatcctttt

SEQ ID NO: 1919 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tataatcatttgaaatatccttt

SEQ ID NO: 1920 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taatcataatcatttgaaatatt

SEQ ID NO: 1921 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttaatcataatcatttgaaattt

SEQ ID NO: 1922 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tctaatcataatcatttgaaatt

SEQ ID NO: 1923 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tactaatcataatcatttgaatt

SEQ ID NO: 1924 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttaactaatcataatcatttgtt

SEQ ID NO: 1925 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tataactaatcataatcattttt

SEQ ID NO: 1926 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tacataactaatcataatcattt

SEQ ID NO: 1927 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgacataactaatcataatcatt

SEQ ID NO: 1928 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tagacataactaatcataatctt

SEQ ID NO: 1929 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttagtgtttttgggaaatcaatt

SEQ ID NO: 1930 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tctttagtgtttttgggaaattt

SEQ ID NO: 1931 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcctttagtgtttttgggaaatt

SEQ ID NO: 1932 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcacctttagtgtttttgggatt

SEQ ID NO: 1933 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tccacctttagtgtttttgggtt

SEQ ID NO: 1934 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taccacctttagtgtttttggtt

SEQ ID NO: 1935 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taacaataagttaaaacatgatt

SEQ ID NO: 1936 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgcaacaataagttaaaacattt

SEQ ID NO: 1937 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tagcaacaataagttaaaacatt

SEQ ID NO: 1938 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgttttcagcaacaataagtttt

SEQ ID NO: 1939 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgagttttcagcaacaataagtt

SEQ ID NO: 1940 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tagagttttcagcaacaataatt

SEQ ID NO: 1941 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttagagttttcagcaacaatatt

SEQ ID NO: 1942 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgacatagagttttcagcaactt

SEQ ID NO: 1943 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tcacataaaagctacattttttt

SEQ ID NO: 1944 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgtttcataaccaaagcttcctt

SEQ ID NO: 1945 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgtttcataaccaaagcttctt

SEQ ID NO: 1946 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgcgataaaaagcatttaaattt

SEQ ID NO: 1947 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tagcgataaaaagcatttaaatt

SEQ ID NO: 1948 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttagcgataaaaagcatttaatt

SEQ ID NO: 1949 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tttagcgataaaaagcatttatt

SEQ ID NO: 1950 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttttagcgataaaaagcattttt

SEQ ID NO: 1951 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatttagcgataaaaagcatttt

SEQ ID NO: 1952 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tagtcatttagcgataaaaagtt

SEQ ID NO: 1953 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taagtcatttagcgataaaaatt

SEQ ID NO: 1954 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgcaagtcatttagcgataaatt

SEQ ID NO: 1955 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgcaagtcatttagcgataatt

SEQ ID NO: 1956 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttctgcaagtcatttagcgattt

SEQ ID NO: 1957 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tttcatctgcaagtcatttagtt

SEQ ID NO: 1958 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tttgtacacagcatttaaacatt

SEQ ID NO: 1959 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tttgttgtacacagcatttaatt

SEQ ID NO: 1960 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tattgttgtacacagcatttatt

SEQ ID NO: 1961 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taagcattgttgtacacagcatt

SEQ ID NO: 1962 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttcaaagcattgttgtacacatt

SEQ ID NO: 1963 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatcaaagcattgttgtacactt

SEQ ID NO: 1964 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttatcaaagcattgttgtacatt

SEQ ID NO: 1965 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
ttgaatcatttcaaaattatctt

SEQ ID NO: 1966 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tatgaatcatttcaaaattattt

SEQ ID NO: 1967 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgatgaatcatttcaaaattatt

SEQ ID NO: 1968 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
taaagatgaatcatttcaaaatt

SEQ ID NO: 1969 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgaaagatgaatcatttcaaatt

SEQ ID NO: 1970 - RNA, 23 nt, synthetic construct
  source 1..23: mol_type = other RNA
  modified_base order(1,4,11,12,16,18,21..23): mod_base = OTHER; note = 2 prime-O-methyl nucleosides
  modified_base order(2, 3, 5..10,13..15,17,19..20): mod_base = OTHER; note = 2 prime-hydroxy nucleosides
tgattcatacttttatttctgtt

SEQ ID NO: 1971 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2, 3, 5..10,13..15,17,19..20): mod_base = OTHER; note = 2 prime-hydroxy nucleosides
  modified_base order(2..3,5..8,10,14): mod_base = OTHER; note = 2 prime-fluoro nucleosides
tttgctctgaggaactcaagaag

SEQ ID NO: 1972 - RNA, 23 nt, synthetic construct
  source 1..23: mol_type = other RNA
  modified_base order(1..3,21..23): mod_base = OTHER; note = phosphorothioate linkages
  modified_base order(1,4..6,8..9,11..13,15..23): mod_base = OTHER; note = 2 prime-O-methyl nucleosides
  modified_base order(2, 3, 5..10,13..15,17,19..20): mod_base = OTHER; note = 2 prime-hydroxy nucleosides
  modified_base order(2..3,7,10,14): mod_base = OTHER; note = 2 prime-fluoro nucleosides
tttgctctgaggaactcaagaag

SEQ ID NO: 1973 - RNA, 23 nt, synthetic construct
  source 1..23: mol_type = other RNA
  modified_base order(1..3,21..23): mod_base = OTHER; note = phosphorothioate linkages
  modified_base order(1,4,6,9,11..13,15..23): mod_base = OTHER; note = 2 prime-O-methyl nucleosides
  modified_base order(2, 3, 5..10,13..15,17,19..20): mod_base = OTHER; note = 2 prime-hydroxy nucleosides
  modified_base order(2..3,5,7..8,10,14): mod_base = OTHER; note = 2 prime-fluoro nucleosides
tttgctctgaggaactcaagaag

SEQ ID NO: 1974 - RNA, 23 nt, synthetic construct
  source 1..23: mol_type = other RNA
  modified_base order(1..3,21..23): mod_base = OTHER; note = phosphorothioate linkages
  modified_base order(1,4,8..9,11..13,15..23): mod_base = OTHER; note = 2 prime-O-methyl nucleosides
  modified_base order(2, 3, 5..10,13..15,17,19..20): mod_base = OTHER; note = 2 prime-hydroxy nucleosides
  modified_base order(2..3,5..7,10,14): mod_base = OTHER; note = 2 prime-fluoro nucleosides
tttgctctgaggaactcaagaag

SEQ ID NO: 1975 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2, 3, 5..10,13..15,17,19..20): mod_base = OTHER; note = 2 prime-hydroxy nucleosides
  modified_base order(2..3,5..8,10,14): mod_base = OTHER; note = 2 prime-fluoro nucleosides
ttgtcattgagaaacatgcgcag

SEQ ID NO: 1976 - RNA, 23 nt, synthetic construct
  source 1..23: mol_type = other RNA
  modified_base order(1..3,21..23): mod_base = OTHER; note = phosphorothioate linkages
  modified_base order(1,4..6,8..9,11..13,15..23): mod_base = OTHER; note = 2 prime-O-methyl nucleosides
  modified_base order(2, 3, 5..10,13..15,17,19..20): mod_base = OTHER; note = 2 prime-hydroxy nucleosides
  modified_base order(2..3,7,10,14): mod_base = OTHER; note = 2 prime-fluoro nucleosides
ttgtcattgagaaacatgcgcag

SEQ ID NO: 1977 - RNA, 23 nt, synthetic construct
  source 1..23: mol_type = other RNA
  modified_base order(1..3,21..23): mod_base = OTHER; note = phosphorothioate linkages
  modified_base order(1,4,6,9,11..13,15..23): mod_base = OTHER; note = 2 prime-O-methyl nucleosides
  modified_base order(2, 3, 5..10,13..15,17,19..20): mod_base = OTHER; note = 2 prime-hydroxy nucleosides
  modified_base order(2..3,5,7..8,10,14): mod_base = OTHER; note = 2 prime-fluoro nucleosides
ttgtcattgagaaacatgcgcag

SEQ ID NO: 1978 - RNA, 23 nt, synthetic construct
  source 1..23: mol_type = other RNA
  modified_base order(1..3,21..23): mod_base = OTHER; note = phosphorothioate linkages
  modified_base order(1,4,8..9,11..13,15..23): mod_base = OTHER; note = 2 prime-O-methyl nucleosides
  modified_base order(2, 3, 5..10,13..15,17,19..20): mod_base = OTHER; note = 2 prime-hydroxy nucleosides
  modified_base order(2..3,5..7,10,14): mod_base = OTHER; note = 2 prime-fluoro nucleosides
ttgtcattgagaaacatgcgcag

SEQ ID NO: 1979 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2, 3, 5..10,13..15,17,19..20): mod_base = OTHER; note = 2 prime-hydroxy nucleosides
  modified_base order(2..3,5..8,10,14): mod_base = OTHER; note = 2 prime-fluoro nucleosides
ttaactgtgggtaaagagctaag

SEQ ID NO: 1980 - RNA, 23 nt, synthetic construct
  source 1..23: mol_type = other RNA
  modified_base order(1..3,21..23): mod_base = OTHER; note = phosphorothioate linkages
  modified_base order(1,4..6,8..9,11..13,15..23): mod_base = OTHER; note = 2 prime-O-methyl nucleosides
  modified_base order(2, 3, 5..10,13..15,17,19..20): mod_base = OTHER; note = 2 prime-hydroxy nucleosides
  modified_base order(2..3,7,10,14): mod_base = OTHER; note = 2 prime-fluoro nucleosides
ttaactgtgggtaaagagctaag

SEQ ID NO: 1981 - RNA, 23 nt, synthetic construct
  source 1..23: mol_type = other RNA
  modified_base order(1..3,21..23): mod_base = OTHER; note = phosphorothioate linkages
  modified_base order(1,4,6,9,11..13,15..23): mod_base = OTHER; note = 2 prime-O-methyl nucleosides
  modified_base order(2, 3, 5..10,13..15,17,19..20): mod_base = OTHER; note = 2 prime-hydroxy nucleosides
  modified_base order(2..3,5,7..8,10,14): mod_base = OTHER; note = 2 prime-fluoro nucleosides
ttaactgtgggtaaagagctaag

SEQ ID NO: 1982 - RNA, 23 nt, synthetic construct
  source 1..23: mol_type = other RNA
  modified_base order(1..3,21..23): mod_base = OTHER; note = phosphorothioate linkages
  modified_base order(1,4,8..9,11..13,15..23): mod_base = OTHER; note = 2 prime-O-methyl nucleosides
  modified_base order(2, 3, 5..10,13..15,17,19..20): mod_base = OTHER; note = 2 prime-hydroxy nucleosides
  modified_base order(2..3,5..7,10,14): mod_base = OTHER; note = 2 prime-fluoro nucleosides
ttaactgtgggtaaagagctaag

SEQ ID NO: 1983 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2, 3, 5..10,13..15,17,19..20): mod_base = OTHER; note = 2 prime-hydroxy nucleosides
  modified_base order(2..3,5..8,10,14): mod_base = OTHER; note = 2 prime-fluoro nucleosides
tatactggcaggtcattcagtag

SEQ ID NO: 1984 - RNA, 23 nt, synthetic construct
  source 1..23: mol_type = other RNA
  modified_base order(1..3,21..23): mod_base = OTHER; note = phosphorothioate linkages
  modified_base order(1,4..6,8..9,11..13,15..23): mod_base = OTHER; note = 2 prime-O-methyl nucleosides
  modified_base order(2, 3, 5..10,13..15,17,19..20): mod_base = OTHER; note = 2 prime-hydroxy nucleosides
  modified_base order(2..3,7,10,14): mod_base = OTHER; note = 2 prime-fluoro nucleosides
tatactggcaggtcattcagtag

SEQ ID NO: 1985 - RNA, 23 nt, synthetic construct
  source 1..23: mol_type = other RNA
  modified_base order(1..3,21..23): mod_base = OTHER; note = phosphorothioate linkages
  modified_base order(1,4,6,9,11..13,15..23): mod_base = OTHER; note = 2 prime-O-methyl nucleosides
  modified_base order(2, 3, 5..10,13..15,17,19..20): mod_base = OTHER; note = 2 prime-hydroxy nucleosides
  modified_base order(2..3,5,7..8,10,14): mod_base = OTHER; note = 2 prime-fluoro nucleosides
tatactggcaggtcattcagtag

SEQ ID NO: 1986 - RNA, 23 nt, synthetic construct
  source 1..23: mol_type = other RNA
  modified_base order(1..3,21..23): mod_base = OTHER; note = phosphorothioate linkages
  modified_base order(1,4,8..9,11..13,15..23): mod_base = OTHER; note = 2 prime-O-methyl nucleosides
  modified_base order(2, 3, 5..10,13..15,17,19..20): mod_base = OTHER; note = 2 prime-hydroxy nucleosides
  modified_base order(2..3,5..7,10,14): mod_base = OTHER; note = 2 prime-fluoro nucleosides
tatactggcaggtcattcagtag

SEQ ID NO: 1987 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2, 3, 5..10,13..15,17,19..20): mod_base = OTHER; note = 2 prime-hydroxy nucleosides
  modified_base order(2..3,5..8,10,14): mod_base = OTHER; note = 2 prime-fluoro nucleosides
tgatttgtgatgaaatggacaag

SEQ ID NO: 1988 - RNA, 23 nt, synthetic construct
  source 1..23: mol_type = other RNA
  modified_base order(1..3,21..23): mod_base = OTHER; note = phosphorothioate linkages
  modified_base order(1,4..6,8..9,11..13,15..23): mod_base = OTHER; note = 2 prime-O-methyl nucleosides
  modified_base order(2, 3, 5..10,13..15,17,19..20): mod_base = OTHER; note = 2 prime-hydroxy nucleosides
  modified_base order(2..3,7,10,14): mod_base = OTHER; note = 2 prime-fluoro nucleosides
tgatttgtgatgaaatggacaag

SEQ ID NO: 1989 - RNA, 23 nt, synthetic construct
  source 1..23: mol_type = other RNA
  modified_base order(1..3,21..23): mod_base = OTHER; note = phosphorothioate linkages
  modified_base order(1,4,6,9,11..13,15..23): mod_base = OTHER; note = 2 prime-O-methyl nucleosides
  modified_base order(2..3,5,7..8,10,14): mod_base = OTHER; note = 2 prime-fluoro nucleosides
tgatttgtgatgaaatggacaag

SEQ ID NO: 1990 - RNA, 23 nt, synthetic construct
  source 1..23: mol_type = other RNA
  modified_base order(1..3,21..23): mod_base = OTHER; note = phosphorothioate linkages
  modified_base order(1,4,8..9,11..13,15..23): mod_base = OTHER; note = 2 prime-O-methyl nucleosides
  modified_base order(2..3,5..7,10,14): mod_base = OTHER; note = 2 prime-fluoro nucleosides
tgatttgtgatgaaatggacaag

SEQ ID NO: 1991 - RNA, 23 nt, synthetic construct
  source 1..23: mol_type = other RNA
  modified_base order(1..3,21..23): mod_base = OTHER; note = phosphorothioate linkages
  modified_base order(1,4,6,9,11..13,15..23): mod_base = OTHER; note = 2 prime-O-methyl nucleosides
  modified_base order(2..3,5,7..8,10,14): mod_base = OTHER; note = 2 prime-fluoro nucleosides
tctaagtgcattaactgtgggag

SEQ ID NO: 1992 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2..3,5..8,10,14): mod_base = OTHER; note = 2 prime-fluoro nucleosides
tctaagtgcattaactgtgggag

SEQ ID NO: 1993 - RNA, 23 nt, synthetic construct
  source 1..23: mol_type = other RNA
  modified_base order(1..3,21..23): mod_base = OTHER; note = phosphorothioate linkages
  modified_base order(1,4..6,8..9,11..13,15..23): mod_base = OTHER; note = 2 prime-O-methyl nucleosides
  modified_base order(2..3,7,10,14): mod_base = OTHER; note = 2 prime-fluoro nucleosides
tctaagtgcattaactgtgggag

SEQ ID NO: 1994 - RNA, 23 nt, synthetic construct
  source 1..23: mol_type = other RNA
  modified_base order(1..3,21..23): mod_base = OTHER; note = phosphorothioate linkages
  modified_base order(1,4,8..9,11..13,15..23): mod_base = OTHER; note = 2 prime-O-methyl nucleosides
  modified_base order(2..3,5..7,10,14): mod_base = OTHER; note = 2 prime-fluoro nucleosides
tctaagtgcattaactgtgggag

SEQ ID NO: 1995 - RNA, 23 nt, synthetic construct
  source 1..23: mol_type = other RNA
  modified_base order(1..3,21..23): mod_base = OTHER; note = phosphorothioate linkages
  modified_base order(1,4,6,9,11..13,15..23): mod_base = OTHER; note = 2 prime-O-methyl nucleosides
  modified_base order(2..3,5,7..8,10,14): mod_base = OTHER; note = 2 prime-fluoro nucleosides
tttaactgtgggtaaagagctag

SEQ ID NO: 1996 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2..3,5..8,10,14): mod_base = OTHER; note = 2 prime-fluoro nucleosides
tttaactgtgggtaaagagctag

SEQ ID NO: 1997 - RNA, 23 nt, synthetic construct
  source 1..23: mol_type = other RNA
  modified_base order(1..3,21..23): mod_base = OTHER; note = phosphorothioate linkages
  modified_base order(1,4,8..9,11..13,15..23): mod_base = OTHER; note = 2 prime-O-methyl nucleosides
  modified_base order(2..3,5..7,10,14): mod_base = OTHER; note = 2 prime-fluoro nucleosides
tttaactgtgggtaaagagctag

SEQ ID NO: 1998 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2..3,5..8,10,14): mod_base = OTHER; note = 2 prime-fluoro nucleosides
tcaagaataagccatagacaaag

SEQ ID NO: 1999 - RNA, 23 nt, synthetic construct
  source 1..23: mol_type = other RNA
  modified_base order(1..3,21..23): mod_base = OTHER; note = phosphorothioate linkages
  modified_base order(1,4..6,8..9,11..13,15..23): mod_base = OTHER; note = 2 prime-O-methyl nucleosides
  modified_base order(2..3,7,10,14): mod_base = OTHER; note = 2 prime-fluoro nucleosides
tcaagaataagccatagacaaag

SEQ ID NO: 2000 - RNA, 23 nt, synthetic construct
  source 1..23: mol_type = other RNA
  modified_base order(1..3,21..23): mod_base = OTHER; note = phosphorothioate linkages
  modified_base order(1,4,6,9,11..13,15..23): mod_base = OTHER; note = 2 prime-O-methyl nucleosides
  modified_base order(2..3,5,7..8,10,14): mod_base = OTHER; note = 2 prime-fluoro nucleosides
tcaagaataagccatagacaaag

SEQ ID NO: 2001 - RNA, 23 nt, synthetic construct
  source 1..23: mol_type = other RNA
  modified_base order(1..3,21..23): mod_base = OTHER; note = phosphorothioate linkages
  modified_base order(1,4,8..9,11..13,15..23): mod_base = OTHER; note = 2 prime-O-methyl nucleosides
  modified_base order(2..3,5..7,10,14): mod_base = OTHER; note = 2 prime-fluoro nucleosides
tcaagaataagccatagacaaag

SEQ ID NO: 2002 - RNA, 23 nt, synthetic construct
  source 1..23: mol_type = other RNA
  modified_base order(1..3,21..23): mod_base = OTHER; note = phosphorothioate linkages
  modified_base order(1,4,8..9,11..13,15..23): mod_base = OTHER; note = 2 prime-O-methyl nucleosides
  modified_base order(2..3,5..7,10,14): mod_base = OTHER; note = 2 prime-fluoro nucleosides
tttccgtgagggaattcaaggag

SEQ ID NO: 2003 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2..3,5..8,10,14): mod_base = OTHER; note = 2 prime-fluoro nucleosides
tttccgtgagggaattcaaggag

SEQ ID NO: 2004 - RNA, 23 nt, synthetic construct
  source 1..23: mol_type = other RNA
  modified_base order(1..3,21..23): mod_base = OTHER; note = phosphorothioate linkages
  modified_base order(1,4..6,8..9,11..13,15..23): mod_base = OTHER; note = 2 prime-O-methyl nucleosides
  modified_base order(2..3,7,10,14): mod_base = OTHER; note = 2 prime-fluoro nucleosides
tttccgtgagggaattcaaggag

SEQ ID NO: 2005 - RNA, 23 nt, synthetic construct
  source 1..23: mol_type = other RNA
  modified_base order(1..3,21..23): mod_base = OTHER; note = phosphorothioate linkages
  modified_base order(1,4,6,9,11..13,15..23): mod_base = OTHER; note = 2 prime-O-methyl nucleosides
  modified_base order(2..3,5,7..8,10,14): mod_base = OTHER; note = 2 prime-fluoro nucleosides
tttccgtgagggaattcaaggag

SEQ ID NO: 2006 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2..3,5..8,10,14): mod_base = OTHER; note = 2 prime-fluoro nucleosides
tgtatgacaagggatttgtgaag

SEQ ID NO: 2007 - RNA, 23 nt, synthetic construct
  source 1..23: mol_type = other RNA
  modified_base order(1..3,21..23): mod_base = OTHER; note = phosphorothioate linkages
  modified_base order(1,4..6,8..9,11..13,15..23): mod_base = OTHER; note = 2 prime-O-methyl nucleosides
  modified_base order(2..3,7,10,14): mod_base = OTHER; note = 2 prime-fluoro nucleosides
tgtatgacaagggatttgtgaag

SEQ ID NO: 2008 - RNA, 23 nt, synthetic construct
  source 1..23: mol_type = other RNA
  modified_base order(1..3,21..23): mod_base = OTHER; note = phosphorothioate linkages
  modified_base order(1,4,6,9,11..13,15..23): mod_base = OTHER; note = 2 prime-O-methyl nucleosides
  modified_base order(2..3,5,7..8,10,14): mod_base = OTHER; note = 2 prime-fluoro nucleosides
tgtatgacaagggatttgtgaag

SEQ ID NO: 2009 - RNA, 23 nt, synthetic construct
  source 1..23: mol_type = other RNA
  modified_base order(1..3,21..23): mod_base = OTHER; note = phosphorothioate linkages
  modified_base order(1,4,8..9,11..13,15..23): mod_base = OTHER; note = 2 prime-O-methyl nucleosides
  modified_base order(2..3,5..7,10,14): mod_base = OTHER; note = 2 prime-fluoro nucleosides
tgtatgacaagggatttgtgaag

SEQ ID NO: 2010 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2..3,5..8,10,14): mod_base = OTHER; note = 2 prime-fluoro nucleosides
taaatacccagcttcaaacatag

SEQ ID NO: 2011 - RNA, 23 nt, synthetic construct
  source 1..23: mol_type = other RNA
  modified_base order(1..3,21..23): mod_base = OTHER; note = phosphorothioate linkages
  modified_base order(1,4..6,8..9,11..13,15..23): mod_base = OTHER; note = 2 prime-O-methyl nucleosides
  modified_base order(2..3,7,10,14): mod_base = OTHER; note = 2 prime-fluoro nucleosides
taaatacccagcttcaaacatag

SEQ ID NO: 2012 - RNA, 23 nt, synthetic construct
  source 1..23: mol_type = other RNA
  modified_base order(1..3,21..23): mod_base = OTHER; note = phosphorothioate linkages
  modified_base order(1,4,6,9,11..13,15..23): mod_base = OTHER; note = 2 prime-O-methyl nucleosides
  modified_base order(2..3,5,7..8,10,14): mod_base = OTHER; note = 2 prime-fluoro nucleosides
taaatacccagcttcaaacatag

SEQ ID NO: 2013 - RNA, 23 nt, synthetic construct
  source 1..23: mol_type = other RNA
  modified_base order(1..3,21..23): mod_base = OTHER; note = phosphorothioate linkages
  modified_base order(1,4,8..9,11..13,15..23): mod_base = OTHER; note = 2 prime-O-methyl nucleosides
  modified_base order(2..3,5..7,10,14): mod_base = OTHER; note = 2 prime-fluoro nucleosides
taaatacccagcttcaaacatag

SEQ ID NO: 2014 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2..3,5..8,10,14): mod_base = OTHER; note = 2 prime-fluoro nucleosides
tatgatacgttggaggttttcag

SEQ ID NO: 2015 - RNA, 23 nt, synthetic construct
  source 1..23: mol_type = other RNA
  modified_base order(1..3,21..23): mod_base = OTHER; note = phosphorothioate linkages
  modified_base order(1,4..6,8..9,11..13,15..23): mod_base = OTHER; note = 2 prime-O-methyl nucleosides
  modified_base order(2..3,7,10,14): mod_base = OTHER; note = 2 prime-fluoro nucleosides
tatgatacgttggaggttttcag

SEQ ID NO: 2016 - RNA, 23 nt, synthetic construct
  source 1..23: mol_type = other RNA
  modified_base order(1..3,21..23): mod_base = OTHER; note = phosphorothioate linkages
  modified_base order(1,4,6,9,11..13,15..23): mod_base = OTHER; note = 2 prime-O-methyl nucleosides
  modified_base order(2..3,5,7..8,10,14): mod_base = OTHER; note = 2 prime-fluoro nucleosides
tatgatacgttggaggttttcag

SEQ ID NO: 2017 - RNA, 23 nt, synthetic construct
  source 1..23: mol_type = other RNA
  modified_base order(1..3,21..23): mod_base = OTHER; note = phosphorothioate linkages
  modified_base order(1,4,8..9,11..13,15..23): mod_base = OTHER; note = 2 prime-O-methyl nucleosides
  modified_base order(2..3,5..7,10,14): mod_base = OTHER; note = 2 prime-fluoro nucleosides
tatgatacgttggaggttttcag

SEQ ID NO: 2018 - RNA, 23 nt, synthetic construct
  source 1..23: mol_type = other RNA
  modified_base order(1..3,21..23): mod_base = OTHER; note = phosphorothioate linkages
  modified_base order(1,4..6,8..9,11..13,15..23): mod_base = OTHER; note = 2 prime-O-methyl nucleosides
  modified_base order(2..3,7,10,14): mod_base = OTHER; note = 2 prime-fluoro nucleosides
tctaagtgcattaactgtgggag

SEQ ID NO: 2019 - RNA, 23 nt, synthetic construct
  source 1..23: mol_type = other RNA
  modified_base order(1..3,21..23): mod_base = OTHER; note = phosphorothioate linkages
  modified_base order(1,4,8..9,11..13,15..23): mod_base = OTHER; note = 2 prime-O-methyl nucleosides
  modified_base order(2..3,5..7,10,14): mod_base = OTHER; note = 2 prime-fluoro nucleosides
tctaagtgcattaactgtgggag

SEQ ID NO: 2020 - RNA, 23 nt, synthetic construct
  source 1..23: mol_type = other RNA
  modified_base order(1..3,21..23): mod_base = OTHER; note = phosphorothioate linkages
  modified_base order(1,4,6,9,11..13,15..23): mod_base = OTHER; note = 2 prime-O-methyl nucleosides
  modified_base order(2..3,5,7..8,10,14): mod_base = OTHER; note = 2 prime-fluoro nucleosides
tttaactgtgggtaaagagctag

SEQ ID NO: 2021 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2..3,5..8,10,14): mod_base = OTHER; note = 2 prime-fluoro nucleosides
tttaactgtgggtaaagagctag

SEQ ID NO: 2022 - RNA, 23 nt, synthetic construct
  source 1..23: mol_type = other RNA
  modified_base order(1..3,21..23): mod_base = OTHER; note = phosphorothioate linkages
  modified_base order(1,4..6,8..9,11..13,15..23): mod_base = OTHER; note = 2 prime-O-methyl nucleosides
  modified_base order(2..3,7,10,14): mod_base = OTHER; note = 2 prime-fluoro nucleosides
tttaactgtgggtaaagagctag

SEQ ID NO: 2023 - RNA, 23 nt, synthetic construct
  source 1..23: mol_type = other RNA
  modified_base order(1..3,21..23): mod_base = OTHER; note = phosphorothioate linkages
  modified_base order(1,4,8..9,11..13,15..23): mod_base = OTHER; note = 2 prime-O-methyl nucleosides
  modified_base order(2..3,5..7,10,14): mod_base = OTHER; note = 2 prime-fluoro nucleosides
tttaactgtgggtaaagagctag

SEQ ID NO: 2024 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2..3,5..8,10,14): mod_base = OTHER; note = 2 prime-fluoro nucleosides
ttccaggacatattgtagctcag

SEQ ID NO: 2025 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2..3,5..8,10,14): mod_base = OTHER; note = 2 prime-fluoro nucleosides
ttaaagagctatgatgtcatcag

SEQ ID NO: 2026 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2..3,5..8,10,14): mod_base = OTHER; note = 2 prime-fluoro nucleosides
ttttccgtgagggaattcaagag

SEQ ID NO: 2027 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2..3,5..8,10,14): mod_base = OTHER; note = 2 prime-fluoro nucleosides
tcagcttcaaacatcactcggag

SEQ ID NO: 2028 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2..3,5..8,10,14): mod_base = OTHER; note = 2 prime-fluoro nucleosides
tcatcaagatacctatcatatag

SEQ ID NO: 2029 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2..3,5..8,10,14): mod_base = OTHER; note = 2 prime-fluoro nucleosides
tcaagaataagccatagacaaag

SEQ ID NO: 2030 - RNA, 23 nt, synthetic construct
  source 1..23: mol_type = other RNA
  modified_base order(1..3,21..23): mod_base = OTHER; note = phosphorothioate linkages
  modified_base order(1,4..6,8..9,11..13,15..23): mod_base = OTHER; note = 2 prime-O-methyl nucleosides
  modified_base order(2..3,7,10,14): mod_base = OTHER; note = 2 prime-fluoro nucleosides
tcaagaataagccatagacaaag

SEQ ID NO: 2031 - RNA, 23 nt, synthetic construct
  source 1..23: mol_type = other RNA
  modified_base order(1..3,21..23): mod_base = OTHER; note = phosphorothioate linkages
  modified_base order(1,4,6,9,11..13,15..23): mod_base = OTHER; note = 2 prime-O-methyl nucleosides
  modified_base order(2..3,5,7..8,10,14): mod_base = OTHER; note = 2 prime-fluoro nucleosides
tcaagaataagccatagacaaag

SEQ ID NO: 2032 - RNA, 23 nt, synthetic construct
  source 1..23: mol_type = other RNA
  modified_base order(1..3,21..23): mod_base = OTHER; note = phosphorothioate linkages
  modified_base order(1,4,8..9,11..13,15..23): mod_base = OTHER; note = 2 prime-O-methyl nucleosides
  modified_base order(2..3,5..7,10,14): mod_base = OTHER; note = 2 prime-fluoro nucleosides
tcaagaataagccatagacaaag

SEQ ID NO: 2033 - RNA, 23 nt, synthetic construct
  source 1..23: mol_type = other RNA
  modified_base order(1..3,21..23): mod_base = OTHER; note = phosphorothioate linkages
  modified_base order(1,4,8..9,11..13,15..23): mod_base = OTHER; note = 2 prime-O-methyl nucleosides
  modified_base order(2..3,5..7,10,14): mod_base = OTHER; note = 2 prime-fluoro nucleosides
tttccgtgagggaattcaaggag

SEQ ID NO: 2034 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2..3,5..8,10,14): mod_base = OTHER; note = 2 prime-fluoro nucleosides
tttccgtgagggaattcaaggag

SEQ ID NO: 2035 - RNA, 23 nt, synthetic construct
  source 1..23: mol_type = other RNA
  modified_base order(1..3,21..23): mod_base = OTHER; note = phosphorothioate linkages
  modified_base order(1,4..6,8..9,11..13,15..23): mod_base = OTHER; note = 2 prime-O-methyl nucleosides
  modified_base order(2..3,7,10,14): mod_base = OTHER; note = 2 prime-fluoro nucleosides
tttccgtgagggaattcaaggag

SEQ ID NO: 2036 - RNA, 23 nt, synthetic construct
  source 1..23: mol_type = other RNA
  modified_base order(1..3,21..23): mod_base = OTHER; note = phosphorothioate linkages
  modified_base order(1,4,6,9,11..13,15..23): mod_base = OTHER; note = 2 prime-O-methyl nucleosides
  modified_base order(2..3,5,7..8,10,14): mod_base = OTHER; note = 2 prime-fluoro nucleosides
tttccgtgagggaattcaaggag

SEQ ID NO: 2037 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2..3,5..8,10,14): mod_base = OTHER; note = 2 prime-fluoro nucleosides
ttaatgttcttttcacttcttag

SEQ ID NO: 2038 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2..3,5..8,10,14): mod_base = OTHER; note = 2 prime-fluoro nucleosides
tgtaaaaacatgaccatgtttag

SEQ ID NO: 2039 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2..3,5..8,10,14): mod_base = OTHER; note = 2 prime-fluoro nucleosides
tgtatgacaagggatttgtgaag

SEQ ID NO: 2040 - RNA, 23 nt, synthetic construct
  source 1..23: mol_type = other RNA
  modified_base order(1..3,21..23): mod_base = OTHER; note = phosphorothioate linkages
  modified_base order(1,4..6,8..9,11..13,15..23): mod_base = OTHER; note = 2 prime-O-methyl nucleosides
  modified_base order(2..3,7,10,14): mod_base = OTHER; note = 2 prime-fluoro nucleosides
tgtatgacaagggatttgtgaag

SEQ ID NO: 2041 - RNA, 23 nt, synthetic construct
  source 1..23: mol_type = other RNA
  modified_base order(1..3,21..23): mod_base = OTHER; note = phosphorothioate linkages
  modified_base order(1,4,6,9,11..13,15..23): mod_base = OTHER; note = 2 prime-O-methyl nucleosides
  modified_base order(2..3,5,7..8,10,14): mod_base = OTHER; note = 2 prime-fluoro nucleosides
tgtatgacaagggatttgtgaag

SEQ ID NO: 2042 - RNA, 23 nt, synthetic construct
  source 1..23: mol_type = other RNA
  modified_base order(1..3,21..23): mod_base = OTHER; note = phosphorothioate linkages
  modified_base order(1,4,8..9,11..13,15..23): mod_base = OTHER; note = 2 prime-O-methyl nucleosides
  modified_base order(2..3,5..7,10,14): mod_base = OTHER; note = 2 prime-fluoro nucleosides
tgtatgacaagggatttgtgaag

SEQ ID NO: 2043 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2..3,5..8,10,14): mod_base = OTHER; note = 2 prime-fluoro nucleosides
ttatgatgtcatcttttcggaag

SEQ ID NO: 2044 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2..3,5..8,10,14): mod_base = OTHER; note = 2 prime-fluoro nucleosides
tcattgagaaacatgcgcaggag

SEQ ID NO: 2045 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2..3,5..8,10,14): mod_base = OTHER; note = 2 prime-fluoro nucleosides
tcgtgcctcaagctctctgccag

SEQ ID NO: 2046 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2..3,5..8,10,14): mod_base = OTHER; note = 2 prime-fluoro nucleosides
taaatacccagcttcaaacatag

SEQ ID NO: 2047 - RNA, 23 nt, synthetic construct
  source 1..23: mol_type = other RNA
  modified_base order(1..3,21..23): mod_base = OTHER; note = phosphorothioate linkages
  modified_base order(1,4..6,8..9,11..13,15..23): mod_base = OTHER; note = 2 prime-O-methyl nucleosides
  modified_base order(2..3,7,10,14): mod_base = OTHER; note = 2 prime-fluoro nucleosides
taaatacccagcttcaaacatag

SEQ ID NO: 2048 - RNA, 23 nt, synthetic construct
  source 1..23: mol_type = other RNA
  modified_base order(1..3,21..23): mod_base = OTHER; note = phosphorothioate linkages
  modified_base order(1,4,6,9,11..13,15..23): mod_base = OTHER; note = 2 prime-O-methyl nucleosides
  modified_base order(2..3,5,7..8,10,14): mod_base = OTHER; note = 2 prime-fluoro nucleosides
taaatacccagcttcaaacatag

SEQ ID NO: 2049 - RNA, 23 nt, synthetic construct
  source 1..23: mol_type = other RNA
  modified_base order(1..3,21..23): mod_base = OTHER; note = phosphorothioate linkages
  modified_base order(1,4,8..9,11..13,15..23): mod_base = OTHER; note = 2 prime-O-methyl nucleosides
  modified_base order(2..3,5..7,10,14): mod_base = OTHER; note = 2 prime-fluoro nucleosides
taaatacccagcttcaaacatag

SEQ ID NO: 2050 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2..3,5..8,10,14): mod_base = OTHER; note = 2 prime-fluoro nucleosides
tagcatcagaatcaaaaattgag

SEQ ID NO: 2051 - RNA, 23 nt, synthetic construct
  source 1..23: mol_type = other RNA
  modified_base order(1..3,21..23): mod_base = OTHER; note = phosphorothioate linkages
  modified_base order(1,4,9,11..13,15..23): mod_base = OTHER; note = 2 prime-O-methyl nucleosides
  modified_base order(2..3,5..8,10,14): mod_base = OTHER; note = 2 prime-fluoro nucleosides
tatgatacgttggaggttttcag

SEQ ID NO: 2052 - RNA, 23 nt, synthetic construct
  source 1..23: mol_type = other RNA
  modified_base order(1..3,21..23): mod_base = OTHER; note = phosphorothioate linkages
  modified_base order(1,4..6,8..9,11..13,15..23): mod_base = OTHER; note = 2 prime-O-methyl nucleosides
  modified_base order(2..3,7,10,14): mod_base = OTHER; note = 2 prime-fluoro nucleosides
tatgatacgttggaggttttcag

SEQ ID NO: 2053 - RNA, 23 nt, synthetic construct
  source 1..23: mol_type = other RNA
  modified_base order(1..3,21..23): mod_base = OTHER; note = phosphorothioate linkages
  modified_base order(1,4,6,9,11..13,15..23): mod_base = OTHER; note = 2 prime-O-methyl nucleosides
  modified_base order(2..3,5,7..8,10,14): mod_base = OTHER; note = 2 prime-fluoro nucleosides
tatgatacgttggaggttttcag

SEQ ID NO: 2054 - RNA, 23 nt, synthetic construct
  source 1..23: mol_type = other RNA
  modified_base order(1..3,21..23): mod_base = OTHER; note = phosphorothioate linkages
  modified_base order(1,4,8..9,11..13,15..23): mod_base = OTHER; note = 2 prime-O-methyl nucleosides
  modified_base order(2..3,5..7,10,14): mod_base = OTHER; note = 2 prime-fluoro nucleosides
tatgatacgttggaggttttcag

SEQ ID NO: 2055 - RNA, 23 nt, synthetic construct
  source 1..23: mol_type = other RNA
  modified_base order(1,3,5,7,9,11..13,15,17,19,21..23): mod_base = OTHER; note = 2 prime-O-methyl nucleosides
  modified_base order(2,4,6,8,10,14,16,18,20): mod_base = OTHER; note = 2 prime-fluoro nucleosides
  modified_base order(1..3,20..22): mod_base = OTHER; note = phosphorothioate linkages
tcaagaataagccatagacaaag

SEQ ID NO: 2056 - RNA, 23 nt, synthetic construct
  source 1..23: mol_type = other RNA
  modified_base order(1,5,7,9,11,13,15,17,19,21..23): mod_base = OTHER; note = 2 prime-O-methyl nucleosides
  modified_base order(2..4,6,8,10,12,14,16,18,20): mod_base = OTHER; note = 2 prime-fluoro nucleosides
  modified_base order(1..3,20..22): mod_base = OTHER; note = phosphorothioate linkages
tcaagaataagccatagacaaag

SEQ ID NO: 2057 - RNA, 23 nt, synthetic construct
  source 1..23: mol_type = other RNA
  modified_base order(1,3..5,7,10..13,15,17..23): mod_base = OTHER; note = 2 prime-O-methyl nucleosides
  modified_base order(2,6,8..9,14,16): mod_base = OTHER; note = 2 prime-fluoro nucleosides
  modified_base order(1..3,20..22): mod_base = OTHER; note = phosphorothioate linkages
tcaagaataagccatagacaaag

SEQ ID NO: 2058 - RNA, 23 nt, synthetic construct
  source 1..23: mol_type = other RNA
  modified_base order(1,3..5,7..13,15,17..23): mod_base = OTHER; note = 2 prime-O-methyl nucleosides
  modified_base order(2,6,14,16): mod_base = OTHER; note = 2 prime-fluoro nucleosides
  modified_base order(1..3,20..22): mod_base = OTHER; note = phosphorothioate linkages
tcaagaataagccatagacaaag

SEQ ID NO: 2059 - RNA, 24 nt, synthetic construct
  source 1..24: mol_type = other RNA
  modified_base order(1,3..5,11..14,16,18..24): mod_base = OTHER; note = 2 prime-O-methyl nucleosides
  modified_base order(2,6,9..10,15,17): mod_base = OTHER; note = 2 prime-fluoro nucleosides
  modified_base 22..24: mod_base = OTHER; note = phosphorothioate linkages
tcaagagataagccatagacaaag

SEQ ID NO: 2060 - RNA, 21 nt, synthetic construct
  source 1..21: mol_type = other RNA
  modified_base order(2,4,6,8,12,14,16,18,20): mod_base = OTHER; note = 2 prime-O-methyl nucleosides
  modified_base order(1,3,5,7,9..11,13,15,17,19,21): mod_base = OTHER; note = 2 prime-fluoro nucleosides
  modified_base order(1..3,20^21): mod_base = OTHER; note = phosphorothioate linkages
ttgtctatggcttattcttga

SEQ ID NO: 2061 - RNA, 21 nt, synthetic construct
  source 1..21: mol_type = other RNA
  modified_base order(1..6,8,12..21): mod_base = OTHER; note = 2 prime-O-methyl nucleosides
  modified_base order(7,9..11): mod_base = OTHER; note = 2 prime-fluoro nucleosides
  modified_base order(1..3,20^21): mod_base = OTHER; note = phosphorothioate linkages
ttgtctatggcttattcttga

SEQ ID NO: 2062 - RNA, 21 nt, synthetic construct
  source 1..21: mol_type = other RNA
  modified_base order(1..6,8,10,12,14,16..21): mod_base = OTHER; note = 2 prime-O-methyl nucleosides
  modified_base order(7,9,11,13,15): mod_base = OTHER; note = 2 prime-fluoro nucleosides
  modified_base order(1..3,20^21): mod_base = OTHER; note = phosphorothioate linkages
ttgtctatggcttattcttga

What is claimed is:

1. An RNAi agent for inhibiting expression of Cytochrome P450 family 7 subfamily A member 1 (CYP7A1) in a cell, wherein the RNAi agent comprises a sense strand and an antisense strand forming a duplex region, wherein the antisense strand comprises the nucleobase sequence (5'→3') of UCAAGAAUAAGCCAUAGACAAAG (SEQ ID NO: 1180), and wherein the sense strand is 19-23 nucleosides in length and is at least substantially complementary to the antisense strand.

2. The RNAi agent of claim 1, wherein the sense strand is 21 nucleosides in length and the antisense strand is 23 nucleosides in length.

3. The RNAi agent of claim 1, wherein the antisense strand comprises an overhang of at least 1 nucleoside at the 3' end.

4. The RNAi agent of claim 1, wherein the sense strand comprises the nucleobase sequence (5'→3') of UUGUCUAUGGCUUAUUCUUGA (SEQ ID NO: 404).

5. The RNAi agent of claim 4, wherein the RNAi agent comprises one or more modified nucleosides.

6. The RNAi agent of claim 5, wherein each nucleoside of the antisense strand is a modified nucleoside and each nucleoside of the sense strand is a modified nucleoside.

7. The RNAi agent of claim 5, wherein each nucleoside of the antisense strand is selected from a 2'-F modified nucleoside and a 2'-O-Me modified nucleoside, and each nucleoside of the sense strand is a 2'-modified nucleoside selected from a 2'-F modified nucleoside and a 2'-O-Me modified nucleoside.

8. The RNAi agent of claim 5, wherein the nucleosides at one or more of positions 9, 10, 11, and 12 (counting 5'→3') of the sense strand are 2'-F modified nucleosides.

9. The RNAi agent of claim 5, wherein the nucleosides at one or more of positions 2, 3, 5, 6, 7, 8, 10, and 14 (counting 5'→3') of the antisense strand are 2'-F modified nucleosides.

10. The RNAi agent of claim 5, wherein the RNAi agent comprises one or more phosphorothioate internucleoside linkages in at least one strand.

11. The RNAi agent of claim 10, wherein the first two internucleoside linkages in the sense strand from 5'→3' are phosphorothioate internucleoside linkages.

12. The RNAi agent of claim 10, wherein the first two internucleoside linkages and the last two internucleoside linkages in the antisense strand from 5'→3' are phosphorothioate internucleoside linkages.

13. The RNAi agent of claim 1, wherein the antisense strand comprises the nucleobase sequence of SEQ ID NO: 1180 and a structure (5'→3') selected from the group consisting of [mUs][fCs][mA][fA][mG][fA][mA][fU][mA][fA][mG][mC][mC][fA][mU][fA][mG][fA][mC][fA][mAs][mAs][mG] (SEQ ID NO: 2055),

[mUs][fCs][fA][fA][mG][fA][mA][fU][mA][fA][mG][fC][mC][fA][mU][fA][mG][fA][mC][fA][mAs][mAs][mG] (SEQ ID NO: 2056),

[mUs][fCs][mA][mA][mG][fA][mA][fU][fA][mA][mG][mC][mC][fA][mU][fA][mG][mA][mC][mA][mAs][mAs][mG] (SEQ ID NO: 2057),

[mUs][fCs][mA][mA][mG][fA][mA][mU][mA][mA][mG][mC][mC][fA][mU][fA][mG][mA][mC][mA][mAs][mAs][mG] (SEQ ID NO: 2058), and

[mU][fC][mA][mA][mG][fA][gA][fU][fA][mA][mG][mC][mC][fA][mU][fA][mG][mA][mC][mA][mAs][mAs][mG] (SEQ ID NO: 2059), wherein:

mA, mC, mG, and mU are 2'-O-methyl adenosine, 2'-O-methyl cytidine, 2'-O-methyl guanosine, and 2'-O-methyl uridine, respectively;

fA, fC, fG, and fU are 2'-fluoro adenosine, 2'-fluoro cytidine, 2'-fluoro guanosine, and 2'-fluoro uridine, respectively;

gA is GNA adenosine; and s is a phosphorothioate linkage.

14. The RNAi agent of claim 13, wherein the sense strand comprises the nucleobase sequence of SEQ ID NO: 404 and a structure (5'→3') of (SEQ ID NO: 2060)
[fUs][mUs][fG][mU][fC][mU][fA][mU][fG][fG][fC][mU][fU][mA][fU][mU][fC][mU][fU][mG][fAs], (SEQ ID NO: 2062)
[mUs][mUs][mG][mU][mC][mU][fA][mU][fG][mG][fC][mU][fU][mA][fU][mU][mC][mU][mU][mG][mAs],
and (SEQ ID NO: 2061)
[mUs][mUs][mG][mU][mC][mU][fA][mU][fG][fG][fC][mU][mU][mA][mU][mU][mC][mU][mU][mG][mAs], wherein:

mA, mC, mG, and mU are 2'-O-methyl adenosine, cytidine, guanosine, and uridine, respectively;

fA, fC, fG, and fU are 2'-fluoro adenosine, cytidine, guanosine, and uridine, respectively; and s is a phosphorothioate linkage.

15. The RNAi agent of claim 1, wherein the antisense strand comprises the nucleobase sequence of SEQ ID NO: 1180 and a structure (5'→3') selected from the group consisting of (SEQ ID NO: 2029)
[mUs][fCs][fA][mA][fG][fA][fA][fU][mA][fA][mG][mC][mC][fA][mU][mA][mG][mA][mC][mA][mAs][mAs][mG], (SEQ ID NO: 2031)
[mUs][fCs][fA][mA][fG][mA][fA][fU][mA][fA][mG][mC][mC][fA][mU][mA][mG][mA][mC][mA][mAs][mAs][mG], (SEQ ID NO: 2032)
[mUs][fCs][fA][mA][fG][fA][fA][mU][mA][fA][mG][mC][mC][fA][mU][mA][mG][mA][mC][mA][mAs][mAs][mG],
and (SEQ ID NO: 2030)
[mUs][fCs][fA][mA][mG][mA][fA][mU][mA][fA][mG][mC][mC][fA][mU][mA][mG][mA][mC][mA][mAs][mAs][mG], wherein:

mA, mC, mG, and mU are 2'-O-methyl adenosine, 2'-O-methyl cytidine, 2'-O-methyl guanosine, and 2'-O-methyl uridine, respectively;

fA, fC, fG, and fU are 2'-fluoro adenosine, 2'-fluoro cytidine, 2'-fluoro guanosine, and 2'-fluoro uridine, respectively; and s is a phosphorothioate linkage.

16. The RNAi agent of claim 15, wherein the sense strand comprises the nucleobase sequence of SEQ ID NO: 404 and a structure (5'→3') of

[mUs][mUs][mG][mU][mC][mU][mA][mU][fG][fG][fC][fU][mU][mA][mU][mU][mC][mU][mU][mG][mAs] (SEQ ID NO: 1202), wherein:

mA, mC, mG, and mU are 2'-O-methyl adenosine, 2'-O-methyl cytidine, 2'-O-methyl guanosine, and 2'-O-methyl uridine, respectively;

fA, fC, fG, and fU are 2'-fluoro adenosine, 2'-fluoro cytidine, 2'-fluoro guanosine, and 2'-fluoro uridine, respectively; and s is a phosphorothioate linkage.

17. The RNAi agent of claim 16, further comprising a targeting moiety.

18. The RNAi agent of claim 17, wherein the targeting moiety is covalently linked to the 3' end of the sense strand of the RNAi agent.

19. The RNAi agent of claim 17, wherein the targeting moiety comprises N-acetyl-galactosamine (GalNAc).

20. The RNAi agent of claim 17, wherein the targeting moiety comprises one or more instances of GalNAc attached through a monovalent, bivalent, trivalent, or tetravalent branched linker.

21. The RNAi agent of claim 18, wherein the targeting moiety is of formula:

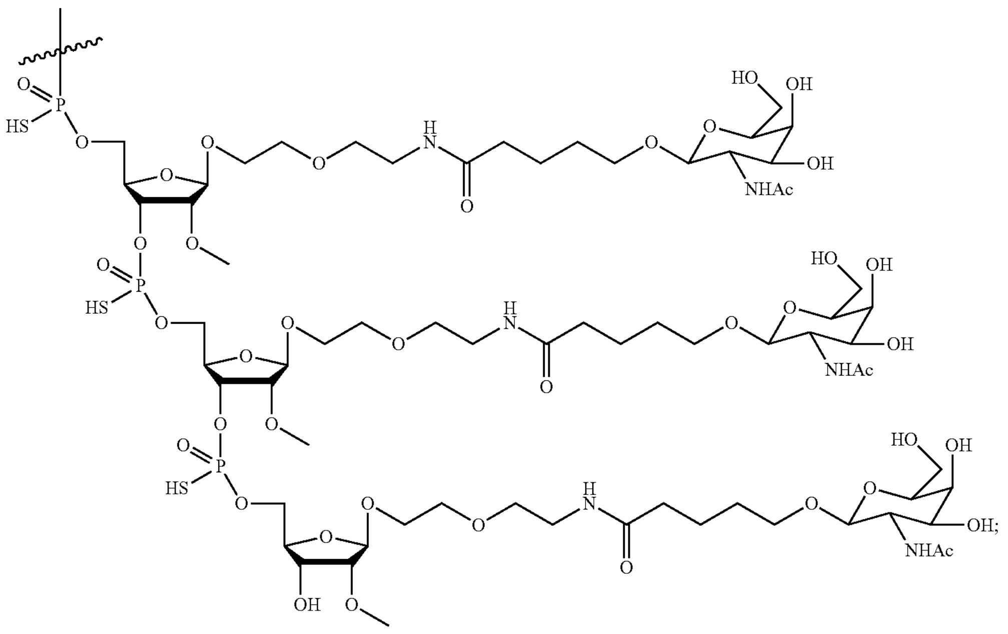

or a pharmaceutically acceptable salt thereof, wherein the

indicates the attachment point that is covalently linked to the 3'-O of the sugar moiety of the 3' terminal nucleoside of the sense strand.

22. A conjugate comprising a Cytochrome P450 family 7 subfamily A member 1 (CYP7A1) RNAi agent covalently linked to a targeting moiety, wherein the CYP7A1 RNAi agent comprises a sense strand and an antisense strand, wherein the antisense strand comprises the nucleobase sequence of SEQ ID NO: 1180 and a structure (5'→3') of

[mUs][fCs][fA][mA][fG][fA][fA][fU][mA][fA][mG][mC][mC][fA][mU][mA][mG][mA][mC][mA][mAs][mAs][mG] (SEQ ID NO: 2029); and wherein the sense strand comprises the nucleobase sequence of SEQ ID NO: 404 and a structure (5'→3') of

[mUs][mUs][mG][mU][mC][mU][mA][mU][fG][fG][fC][fU][mU][mA][mU][mU][mC][mU][mU][mG][mAs] (SEQ ID NO: 1202); wherein:

mA, mC, mG, and mU are 2'-O-methyl adenosine, cytidine, guanosine, and uridine, respectively;

fA, fC, fG, and fU are 2'-fluoro adenosine, cytidine, guanosine, and uridine, respectively; and s is a phosphorothioate linkage;

wherein the targeting moiety is covalently linked to the 3' terminal nucleoside of the sense strand and the s of the 3'-terminal [mAs] of the sense strand corresponds to the phosphorothioate linkage of a first repeat unit of the targeting moiety, wherein the conjugate comprises a structure of:

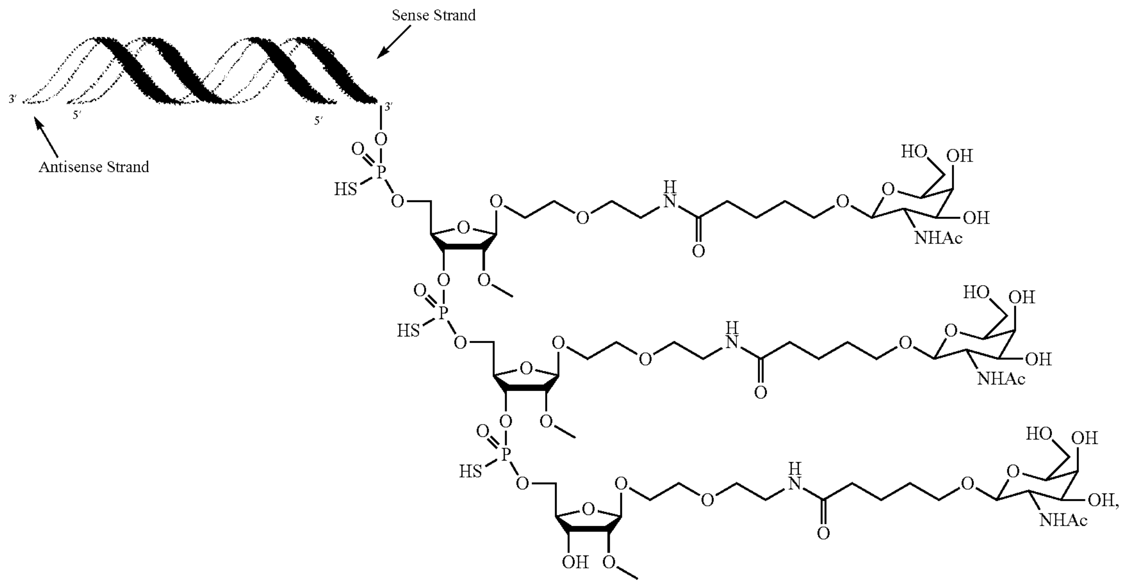

or a pharmaceutically acceptable salt thereof.

23. A pharmaceutical composition for inhibiting expression of a gene encoding CYP7A1 comprising the conjugate of claim 22, or a pharmaceutically acceptable salt thereof.

24. A method of inhibiting expression of a CYP7A1 gene in a cell, the method comprising contacting the cell with the conjugate of claim 22, thereby inhibiting expression of the CYP7A1 gene in the cell.

25. A method of treating a subject having a CYP7A1 disease or CYP7A1-associated disease, comprising administering to the subject a therapeutically effective amount of the conjugate of claim 22, thereby treating the subject having the CYP7A1 disease or CYP7A1-associated disease.

26. The method of claim 25, wherein the CYP7A1 disease or CYP7A1-associated disease is primary sclerosing cholangitis (PSC).

27. The method of claim 25, wherein the subject is human.

* * * * *